United States Patent 12,508,308 (INFLUENZA mRNA VACCINES) - sequence listing, part 21

SEQ ID NO: 75493 - RNA, 1410 nt, Artificial Sequence
  derived and/or modified sequence opt1 from neuraminidase__InfluenzaA__ABB04374
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggucugcaucgccugguccagcuccagcugccacgacggcaaggcguggcuccacgugugcgugaccggggacgacgagaacgccacggccuccuucaucuacgacggccggcuggucgacagcaucggguccuggagccagaacauccugcgcacccaggaguccgagugcgugugcaucaacgggaccugcaccguggucaugacggacggcagcgccuccggccgggcggacacccgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucaaggacuacagcaucgacucccgguacgugugcagcgggcuggugggcgacacgccccgcaacaacgacaaguccagcaacuccaacugccggaaccccaacaacgacaaggggaaccacggcgucaaggggugggccuucgacgacggcaacgacguguggaugggccgcaccaucagcaaggacucccggagcggguacgagaccuucaaggucaucggcgggugguccaccccgaacagcaagucccagaucaaccgccaggugaucguggacagcgacaaccgguccggcuacagcgggaucuucuccgucgagggcaagagcugcaucaaccgcugcuucuacguggagcucauccgcggccgggagcaggagaccaaggugugguggaccagcaacuccaucgucguguucugcgggacgagcggcaccuacgggaccggcuccuggcccgacggggccgacaucaaccugaugcccaucuga

SEQ ID NO: 75494 - RNA, 1410 nt, Artificial Sequence
  derived and/or modified sequence opt1 from neuraminidase__InfluenzaA__ABB04931
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggaagcacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgacaaccgcagcggcuacuccgggaucuucagcguggagggcaagagcugcaucaaccggugcuucuacgucgagcugauccgcggccgcgagcaggagacccgggugugguggacguccaacagcaucguggucuucugcgggaccuccggcaccuacgggaccggcagcuggcccgacggggccgacaucaaccugaugcccaucuga

SEQ ID NO: 75495 - RNA, 1410 nt, Artificial Sequence
  derived and/or modified sequence opt1 from neuraminidase__InfluenzaA__ABB04942
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggagcacccccaacuccaagcugcagaucaaccgccaggugaucguggacagcgacaaccgguccggcuacagcgggaucuucuccgucgagggcaagagcugcaucaaccgcugcuucuacguggagcugauccggggccgcgagcaggagacccgcgugugguggacgagcaacuccaucgucguguucugcgggaccagcggcaccuacgggaccggcuccuggcccgacggggccgacaucaaccucaugcccaucuga

SEQ ID NO: 75496 - RNA, 1410 nt, Artificial Sequence; identical to SEQ ID NO: 75492
  derived and/or modified sequence opt1 from neuraminidase__InfluenzaA__ABB04953

SEQ ID NO: 75497 - RNA, 1410 nt, Artificial Sequence; identical to SEQ ID NO: 75390
  derived and/or modified sequence opt1 from neuraminidase__InfluenzaA__ABB04975

SEQ ID NO: 75498 - RNA, 1410 nt, Artificial Sequence; identical to SEQ ID NO: 75188
  derived and/or modified sequence opt1 from neuraminidase__InfluenzaA__ABB04986

SEQ ID NO: 75499 - RNA, 1410 nt, Artificial Sequence
  derived and/or modified sequence opt1 from neuraminidase__InfluenzaA__ABB04997
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaagcccaucuga

SEQ ID NO: 75500 - RNA, 1410 nt, Artificial Sequence; identical to SEQ ID NO: 75261
  derived and/or modified sequence opt1 from neuraminidase__InfluenzaA__ABB05008

SEQ ID NO: 75501 - RNA, 1410 nt, Artificial Sequence; identical to SEQ ID NO: 75069
  derived and/or modified sequence opt1 from neuraminidase__InfluenzaA__ABB05186

SEQ ID NO: 75502 - RNA, 1410 nt, Artificial Sequence; identical to SEQ ID NO: 75261
  derived and/or modified sequence opt1 from neuraminidase__InfluenzaA__ABB05219

SEQ ID NO: 75503 - RNA, 1410 nt, Artificial Sequence
  derived and/or modified sequence opt1 from neuraminidase__InfluenzaA__ABB46395
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaagcaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggacccacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgacaaccgcagcggcuacuccgggaucuucagcguggagggcaagagcugcaucaaccggugcuucuacgucgagcugauccgcggccgcgagcaggagacgcgggugugguggaccuccaacagcaucguggucuucugcgggaccuccggcaccuacgggacgggcagcuggcccgacggggccgacaucaaccugaugcccaucuga

SEQ ID NO: 75504 - RNA, 1410 nt, Artificial Sequence; identical to SEQ ID NO: 75048
  derived and/or modified sequence opt1 from neuraminidase__InfluenzaA__ABB46417

SEQ ID NO: 75505 - RNA, 1410 nt, Artificial Sequence
  derived and/or modified sequence opt1 from neuraminidase__InfluenzaA__ABB46428
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagccgaacuccaagcuccagaucaaccgccaggugaucguggaccggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggcccgacggcgccgacaucaaccugaugcccaucuga

SEQ ID NO: 75506 - RNA, 1410 nt, Artificial Sequence
  derived and/or modified sequence opt1 from neuraminidase__InfluenzaA__ABB46439
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcgccugcacgguggucaugaccgacggguccgccagcggcaaggcggacaccaagauccucuucaucgaggagcgccggaucgugcacaccagcacgcuguccggcagcgcccagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcgggcuggugggcgacacgccccgcaagaacgacuccagcuccagcuccaacugccucgaccccaacaacgaggagggcgggcacggcgucaaggggugggccuucgacgacggcaacgacguguggauggggcggaccaucagcgagaagcugcgcuccggcuacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcucauccgggggcgcaaggaggagaccgaggugcuguggaccuccaacagcaucgucguguucugcggcaccuccggcgccuacgggaccggcagcuggccggacggggccgacaucaaccugaugcccaucuga

SEQ ID NO: 75507 - RNA, 1410 nt, Artificial Sequence; identical to SEQ ID NO: 75354
  derived and/or modified sequence opt1 from neuraminidase__InfluenzaA__ABB46450

SEQ ID NO: 75508 - RNA, 1410 nt, Artificial Sequence; identical to SEQ ID NO: 75335
  derived and/or modified sequence opt1 from neuraminidase__InfluenzaA__ABB46461

SEQ ID NO: 75509 - RNA, 1410 nt, Artificial Sequence
  derived and/or modified sequence opt1 from neuraminidase__InfluenzaA__ABB46550
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgccuggagcuccagcuccugccacgacggcaaggccuggcuccacgucugcgugaccggguacgacaagaacgcgaccgccagcuucaucuacgacggccggcugguggacuccaucgggagcugguccaagaacauccugcgcacccaggagagcgagugcgucugcgugaacgggaccugcacgguggucaugaccgacggcuccgccagcgagcgggccgacaccaagauccucuucaucgaggagggcaagaucgugcacaucagcccccuguccggcagcgcgcagcacguggaggagugcuccugcuacccgcgcuaccccgggguccggugcgugugccgcgacaacuggaagggcagcaaccggcccguggucgacaucaacgugaaggacuacuccaucgugagcuccuacgucugcagcggccuggugggggacacgccccgcaagaacgaccgguccagcuccagcuacugccgcaacccgaacaacgagaagggcaaccacggggucaagggcugggccuucgacgacgggaacgacguguggaugggccggaccaucuccgaggagagccgcuccggcuacgagaccuucaaggugaucgggggcuggagcacccccaacuccaagagccagaucaaccggcaggucaucguggacuccgggaaccgcagcggcuacagcgggaucuucuccguggagggcaagagcugcaucaaccggugcuucuacgucgagcucauccgcggccgcgagcaggagacccgggugugguggacguccaacagcaucguggucuucugcgggaccuccggcaccuacgggaccggcagcuggcccgacggggccgacaucaaccugaugcccaucuga

SEQ ID NO: 75510 - RNA, 1410 nt, Artificial Sequence
  derived and/or modified sequence opt1 from neuraminidase__InfluenzaA__ABB51955
augaaccccaaccagaagaucaucaccaucggcagcgugucccugaccaucagcacgaucugcuucuucaugcagaucgccauccucgucaccaccgugacccugcacuucaagcaguacgagugcaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacggccacuccaacgacaucguccacgaccgcaccccguaccggacccugcucaugaacgagcugggcgugcccuuccaccuggggaccaagcaggucugcaucgccuggagcuccagcuccugccacgacggcaaggccuggcuccacgugugcgugacgggggacgacgagaacgcgaccgccagcuucaucuacaacggccgccugguggacuccaucgggagcugguccaagaaguucuuccggacccaggagagcgagugcgucugcauccacgggaccugcacgguggugaugaccgacggcuccgccagccgcaaggccgacaccaagauccuguucaucgaggagggcaagaucguccacaccagcacgcucuccggcagcgcgcagcacguggaggagugcuccugcuacccccgguaccccggggugcgcugcgucugccgggacaacuggaagggcagcaaccgcccgaucguggacaucaacaucaaggacuacuccaucgugagcuccuacgucugcagcggccuggugggggacacgccccggaagaacgacuccagcuccagcucccacugccuggaccccaacaacgaggagggcgggcacggcgugaaggggugggccuucgacgacggcaacgacgucuggaugggccgcaccaucagcgagaagcuccgguccggguacgagaccuucaaggugaucgagggcuggagcaagcccaacuccaagcugcagaucaaccgccaggucaucguggaccgggggaaccgcagcggcuacuccgggaucuucagcguggagggcaagagcugcaucaaccggugcuucuacgucgagcugauccgcggccggaagcaggagaccgaggugcucuggaccuccaacagcaucguggucuucugcgggaccuccggcaccuacgggacgggcagcuggccggacggggccgacaucaaccugaugcccaucuga

SEQ ID NO: 75511 - RNA, 1413 nt, Artificial Sequence
  derived and/or modified sequence opt1 from neuraminidase__InfluenzaA__ABB51956
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucaccguggccggcaacuccagccugugcuccaucagcggcugggccaucuacaccaaggacaacuccauccggaucgggagcaagggcgacguguucgucauccgcgagccguucaucuccugcagccaccuggagugccggacguucuuccucacccagggggcccugcugaacgacaagcacuccaacggcaccgugaaggaccgcagccccuaccgggcccucauguccugcccccugggggaggcgcccagcccguacaacagcaaguucgaguccguggccuggagcgccuccgccugccacgacggcaugggcuggcugaccaucgggaucagcggccccgacaacggggcggucgccgugcucaaguacaacggcaucaucacggagaccaucaaguccuggaagaagcccauccugggcacccaggagagcgagugggugugcgucaacggguccugcuucaccaucaugacggacgaccccagcuacgaggccgccuccuacaagaucuucaagaucgagcgcgagcgggugaccaagagcaucgagcugaacgccccgaacuuccacuacgaggagugcuccugcuaccccgacaccggcaccgugaugugcgucugccgcgacaacuggcacgggagcaaccggcccuggguguccuucaaccagaaccucgacuaccagaucggcuacaucugcagcgggguguucggcgacaacccccgcccgaaggacggcgagggguccugcaaccccgucacgguggacggcgcgaacggggugaagggcuucagcuacaaguacgggaacggcgucuggaucggccggaccaaguccaaccgccugcggaagggguucgagaugaucugggaccccaacggcuggaccgacaccgacagcgacuucuccgugaagcaggacguggucgccaucacggacuggagcggguacagcggcuccuucgugcagcaccccgagcugaccgggcucgacugcauccgcccgugcuucugggucgagcuggugcggggccugcccaaggagaacaccaccaucuggacgagcggcuccagcaucuccuucugcggggugaacagcgacaccgccaacugguccuggcccgacggcgccgagcuccccuucaccaucgacaaguga

SEQ ID NO: 75512 - RNA, 1410 nt, Artificial Sequence
  derived and/or modified sequence opt1 from neuraminidase__InfluenzaA__ABB51957
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccgcgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagaucuuccggacccagaaguucgagugcgucugcauccacuggacgugcaccguggugaugaccgacggcuccgccagcggcaaggcggacaccaagauccucuucaucgaggaggggaagaucguccacaucuccacgcugagcggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccuggugggggacacgccccgcaagaacgacuccuucagcuccagccacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacagcaagcugcagaucaaccgccaggugaucguggagcgggggaaccgguccggcuacagcgggaucuucuccgucgagggcaagagcugcaucaaccgcugcuucuacguggagcucauccggggccgcaaggaggagaccgaggugugguggaccuccaacagcaucgucguguucugcgggaccagcggcaccuacgggacgggcuccuggccggacggggccgacaucaaccugaugcccaucuga

SEQ ID NO: 75513 - RNA, 1413 nt, Artificial Sequence
  derived and/or modified sequence opt1 from neuraminidase__InfluenzaA__ABB51958
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugagcaucaacaacacgaacgugaucgcggggaaggacaagaccuccgucacccuggccggcaacagcucccugugcccgauccggggcugggccaucuacaccaaggggaacagcauccgcaucggcuccaagggggacguguucgugauccgggagcccuucaucagcugcucccaccucgagugccgcacguucuuccugacccagggcgcccugcucaacgacaagcacagcaacgggaccgucaaggaccggucccccuaccgcgcccugaugagcugcccccugggcgaggcgccgucccccuacaacagcaaguucgagagcguggccugguccgccagcgccugccacgacggcaugggguggcucaccaucggcaucuccgggcccgacaacggcgcgguggccguccugaaguacaacggcaucaucacggagaccaucaagagcuggaagaagcagauccugcggacccaggaguccgagugcgugugcgugaacgggagcugcuucaccaucaugacggacggccccuccaacggggccgccagcuacaagaucuucaagaucgagaagggcaaggucaccaaguccaucgagcucaacgccccgaacuuccacuacgaggagugcagccgcuaccccgacaccgggaccgugaugugcgugugccgggacaacuggcacggcuccaaccgccccugggucagcuucaaccagaaccuggacuaccagaucggcuacaucugcuccgggguguucggcgacaacccccggccgaaggacggggagggcagcugcaaccccgugacggucgacggggcgaacggcgugaagggcuucuccuacaaguacgggaacggcguggggaucggccgcaccaucagcaaccggcugcgcaagggguucgagaugaucugggaccccaacggcuggaccgacaccgacuccgacuucagcgucaagcaggacgugguggccaucacggacugguccggcuacagcgggagcuucguccagcaccccgagcucaccggccuggacugcauccggccgugcuucuggguggagcugguccgcgggcuccccaaggagaacaccaccaucuggacguccggcagcuccaucagcuucugcggcgugaacuccgacaccgccaacuggagcuggcccgacggggccgagcugcccuucaccaucgacaaguga

SEQ ID NO: 75514 - RNA, 1410 nt, Artificial Sequence
  derived and/or modified sequence opt1 from neuraminidase__InfluenzaA__ABB51959
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaacgaggaggggaagaucgugcacacgagcacgugcuccggcagcgcgcagcacguggaggagugcuccugcuacagccgcuaccccgggguccggugcgugugccgcgacaacuggaagggcuccaaccggcccaucguggacaucaacaucaaggacuacagcaucgucuccagcuacgugugcuccggccuggugggggacaccccgcgcaagaacgacagcuccagcuccagccacugccuggaccccaacaacgaggagggcgggcacggcgucaaggggcgggccuucgacgacggcaacgacguguggaugggccgcaccaucuccgagaagcuccggagcggguacgagaccuucaaggucaucgagggcugguccaaccccaacagcaagcugcagaucaaccgccaggugaucguggaccgggggaaccgcuccggcuacagcgggaucuucagcgucgagggcaaguccugcaucaaccggugcuucuacguggagcugauccgcggccggaaggaggagaccgaggugcucuggaccagcaacuccaucgucguguucugcgggaccagcggcacguacgggaccggcuccuggcccgacggggccgacaucaaccugaugccgaucuga

SEQ ID NO: 75515 - RNA, 1413 nt, Artificial Sequence
  derived and/or modified sequence opt1 from neuraminidase__InfluenzaA__ABB51960
augaaccccaaccagaagaucaucaccaucggcagcaucuccaucgccaucgggaucaucagccugaugcuccagaucggcaacaucaucccgaucugggccucccacagcauccagaccgggucccagaaccacacgggcgugugcaaccagcgcaucaucaccuacgagaacagcaccugggucaaccacaccuacgugaacaucaacaacacgaacgugaucgcggggaaggacaagaccuccgucacccuggccggcaacagcucccugugcagcaucuccggcugggccaucuacaccaaggacaacagcauccggaucggguccaagggcgacguguucgugauccgcgagcccuucaucagcugcucccaccucgagugccggacguucuuccugacccagggggcccugcucaacgacaagcacagcaacggcaccgucaaggaccgcucccccuaccgggcccugaugagcugcccccugggggaggcgccgucccccuacaacagcgaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcagauccugcgcacccaggaguccgagugcgugugcgugaacggcagcugcuucaccaucaugacggacgggcccuccaacggcgccgccagcuacaagaucuucaagaucgagaaggggaagaucaccaaguccaucgagcucaacgccccgaacagccacuacgaggagugcuccugcuaccccgacaccggcaccgucaugugcgugugccgggacagcuggcacggguccaaccgccccugggugagcuucaaccagaaccuggacuaccagaucggcuacaucugcuccggcgucuucggggacaacccccggccgaaggacggcgaggggagcugcaaccccgugacgguggacggcgcgaacggggucaagggcuucuccuacgaguacggcaacggggacuggaucggccgcaccaagagcaaccggcugcgcaagggguucgagaugaucugggaccccgacggcuggaccgacaccaacuccgacuucagcgugaagcaggacguggucgccaucacggacuggagcggguacuccggcagcuucgugcagcaccccgagcucaccggccuggugugcauccggccgugcuucugggucgagcuggugcgcgggcuccccaaggagaacaccaccaucuggacguccggcagcuccaucagcuucugcggggucaacuccgacaccgccaacuggagcuggcccgacggcgccgagcugcccuucaccaucgacaaguga

SEQ ID NO: 75516 - RNA, 1410 nt, Artificial Sequence; identical to SEQ ID NO: 75351
  derived and/or modified sequence opt1 from neuraminidase__InfluenzaA__ABB53617

SEQ ID NO: 75517 - RNA, 1410 nt, Artificial Sequence
  derived and/or modified sequence opt1 from neuraminidase__InfluenzaA__ABB53721
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccagcggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgccaccgcguccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcccagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggcguucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 75518 - RNA, 1410 nt, Artificial Sequence
  derived and/or modified sequence opt1 from neuraminidase__InfluenzaA__ABB53754
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgccuggagcuccagcuccugccacgacggcaaggccuggcuccacgucugcgugaccggguacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagcuccagaucaaccgccaggugaucgucgacagcgacaaccgguccggguacagcggcaucuucagcguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 75519 - RNA, 1410 nt, Artificial Sequence; identical to SEQ ID NO: 75111
  derived and/or modified sequence opt1 from neuraminidase__InfluenzaA__ABB54517

SEQ ID NO: 75520 - RNA, 1410 nt, Artificial Sequence
  derived and/or modified sequence opt1 from neuraminidase__InfluenzaA__ABB59999
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacaucaaggacuacuccaucgugagcuccuacgucugcagcggccucgugggggacacgccccgcaagaacgacuccagcuccagcucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggagcaagccgaacuccaagcugcagaucaaccggcaggucaucguggaccgcgggaaccggagcggcuacuccgggaucuucagcguggagggcaagagcugcaucaaccgcugcuucuacgucgagcucauccggggccgcaagcaggagaccgaggugugguggacguccaacagcaucgugaccuucugcgggaccuccggcaccuacgggacgggcagcuggcccgacggggccgacaucaaccugaugcccaucuga

SEQ ID NO: 75521 - RNA, 1410 nt, Artificial Sequence
  derived and/or modified sequence opt1 from neuraminidase__InfluenzaA__ABB60010
augaaccccaaccagaagaucaucaccaucggcagcgugucccugaccaucgccacgaucugcuuccucaugcagaucgccauccuggucaccaccgugacccugcacuucaagcaguacgaguacagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagccgcuacgugugcuccggccucgugggggacacgccccggaagaacgacagcuccagcuccagccacugccugaaccccaacaacgaggagggcgggcacggcgucaaggggugggccuucgacgacggcaacgacguguggaugggccgcaccaucuccgagaaguuccggagcggguacgagaccuucaaggucaucgagggcugguccaagccgaacagcaagcugcagaucaaccgccaggugaucguggaccgggggaaccgcuccggcuacagcgggaucuucuccgucgagggcaagagcugcaucaaccggugcuucuacguggagcucauccgcggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 75522 - RNA, 1410 nt, Artificial Sequence
  derived and/or modified sequence opt1 from neuraminidase__InfluenzaA__ABB77867
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccgccugguggacagcaucggguccuggagcaagaagauccuccggacccaggaguccgagugcgucugcaucaacggcacgugcaccguggugaugaccgacggcagcgccuccgggcgcgcggacaccaagauccuguucaucgaggagggcaagaucguccacaucagccagcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuccagcuccagccacugccugaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggaccggggcaaccgcuccggguacagcggcaucuucuccgucgagggcaagagcugcaucaaccggugcuucuacguggagcugauccgcgggcggaagcaggagaccgaggugugguggacgagcaacuccaucgucguguucugcggcaccagcgggaccuacggcaccggguccuggccggacggcgccgacaucaaccugaugcccaucuga

SEQ ID NO: 75523 - RNA, 1410 nt, Artificial Sequence; identical to SEQ ID NO: 75522
  derived and/or modified sequence opt1 from neuraminidase__InfluenzaA__ABB79719

SEQ ID NO: 75524 - RNA, 1410 nt, Artificial Sequence
  derived and/or modified sequence opt1 from neuraminidase__InfluenzaA__ABB79734
augaaccccaaccagaagaucaucaccaucggcagcgugucccugacccucagcacgaucugcuucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaagaagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccucgugggcgacacgccccgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 75525 - RNA, 1410 nt, Artificial Sequence; identical to SEQ ID NO: 75495
  derived and/or modified sequence opt1 from neuraminidase__InfluenzaA__ABB79791

SEQ ID NO: 75526 - RNA, 1410 nt, Artificial Sequence
  derived and/or modified sequence opt1 from neuraminidase__InfluenzaA__ABB79802
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacgagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcuacugccggaacccgaacaacgagaagggcucccacggggucaagggcugggccuucgacgacgggaacgacguguggaugggccgcaccaucggcgaggagcuccggagcggguacgagaccuucaaggucaucggcgggugguccacccccaacagcaagcugcagaucaaccgccaggugaucguggacuccggcaaccggagcggguacuccggcaucuucagcgucgagggcaagagcugcaucaaccgcugcuucuacguggagcugauccgggggcgcgagcaggagacccgcgugugguggacguccaacagcaucgucguguucugcggcaccuccgggaccuacggcaccgggagcuggcccgacggcgccgacaucaaccucaugcccaucuga

SEQ ID NO: 75527 - RNA, 1410 nt, Artificial Sequence
  derived and/or modified sequence opt1 from neuraminidase__InfluenzaA__ABB79813
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggaggugugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcuggucgacagcaucggguccuggagcaagaacauccuccgcacccaggaguccgagugcgugugcaucaacggcacgugcaccguggucaugaccgacggcagcgccuccgagcgggcggacaccaagauccuguucaucgaggaggggaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggagcaagccgaacuccaagcugcagaucaaccgccaggugaucgucgaccgggggaaccgcagcggcuacuccgggaucuucagcguggagggcaagagcugcaucaaccggugcuucuacguggagcucauccgcggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 75528 - RNA, 1410 nt, Artificial Sequence; identical to SEQ ID NO: 75527
  derived and/or modified sequence opt1 from neuraminidase__InfluenzaA__ABB79960

SEQ ID NO: 75529 - RNA, 1410 nt, Artificial Sequence; identical to SEQ ID NO: 75527
  derived and/or modified sequence opt1 from neuraminidase__InfluenzaA__ABB79971

SEQ ID NO: 75530 - RNA, 1413 nt, Artificial Sequence
  derived and/or modified sequence opt1 from neuraminidase__InfluenzaA__ABB79982
augaacgccaaccagaagaucaucaccaucggcagcaucuccaucgccaucgggaucaucagccugaugcuccagaucggcaacaucaucuccaucugggcgagccacuccauccagaccgggagccagaaccacacgggcgugugcaaccagcgcaucaucaccuacgagaacuccaccugggucaaccacaccuacgugaacaucaacaacacgaacgugaucgccgggaaggacaagaccagcgucacccuggccggcaacuccagccugugcuccaucagcggcugggccaucuacaccaaggacaacuccauccggaucgggagcaagggcgacguguucgugauccgcgagcccuucaucuccugcagccaccucgagugccggacguucuuccugacccagggggcccugcucaacgacaagcacuccaacggcaccgucaaggaccgcagcccguaccgggcgcugauguccugcccccugggggaggcccccagccccuacaacagcaaguucgaguccguggccuggagcgccuccgcgugccacgacggcaugggcuggcucaccaucgggaucagcggcccggacaacggggccguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcgcccaacuuccacuacgaggagugcuccugcuaccccgacaccggcaccgugaugugcgugugccgggacaacuggcacgggagcaaccgcccgugggucuccuucaaccagaaccuggacuaccagaucggcuacaucugcagcggcguguucggggacaacccccggcccaaggacggcgagggguccugcaaccccgugacggucgacggcgccaacggggugaagggcuucagcuacaaguacggcaacgggguguggaucggccgcaccaaguccaaccggcugcgcaagggguucgagaugaucugggacccgaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcuccccaaggagaacaccaccaucuggacgagcggcuccagcaucuccuucugcggggugaacagcgacaccgccaacugguccuggccggacggcgccgagcugcccuucaccaucgacaaguga

SEQ ID NO: 75531 - RNA, 1413 nt, Artificial Sequence; identical to SEQ ID NO: 75459
  derived and/or modified sequence opt1 from neuraminidase__InfluenzaA__ABB79993

SEQ ID NO: 75532 - RNA, 1410 nt, Artificial Sequence
  derived and/or modified sequence opt1 from neuraminidase__InfluenzaA__ABB80004
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaccgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 75533 - RNA, 1410 nt, Artificial Sequence; identical to SEQ ID NO: 75517
  derived and/or modified sequence opt1 from neuraminidase__InfluenzaA__ABB80015

SEQ ID NO: 75534 - RNA, 1410 nt, Artificial Sequence
  derived and/or modified sequence opt1 from neuraminidase__InfluenzaA__ABB80037
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaucaucaucgagcgcaacaucacggagaucguguaccucaacaacaccaccaucgagaaggagaucugccccaagcugguggaguaccggaacugguccaagccgcagugcaagaucaccggguucgcccccuucagcaaggacaacuccauccgccugagcgccggcggggacaucugggucacgcgggagcccuacguguccugcgaccccggcaagugcuaccaguucgcccucgggcagggcaccacccuggacaacaagcacagcaacgacaccauccacgaccgcaucccgcaccggacgcugcucaugaacgagcugggcgugcccuuccaccuggggacccgccaggucugcaucgccugguccagcuccagcugccacgacggcaaggcguggcuccacgugugcgugaccggggacgacaagaacgccaccgccuccuucaucuacgacggccggcuggucgacagcaucggguccuggagccagaacauccugcgcacgcaggaguccgagugcgugugcaucaacgggaccugcaccguggucaugaccgacggcagcgccuccggccgggcggacacgcgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucgaggacuacagcaucgacuccagcuacgugugcuccgggcuggugggcgacacgccccggaacaacgaccgcagcuccaacagcaacugccggaaccccaacaacgagcgcgggaaccacggcgucaaggggugggccuucgacgacggcaacgacguguggaugggccggaccaucuccaaggaccuccgcagcggguacgagaccuucaaggucaucggcgggugguccaccccgaacagcaagucccagaucaaccgccaggugaucguggacagcgacaaccgguccggcuacagcgggaucuucuccgucgagggcaagagcugcaucaaccgcugcuucuacguggagcugauccggggccgcgagcaggagacccgggugugguggaccagcaacuccaucgucguguucugcgggaccagcggcacguacgggaccggcuccuggcccgacggggccgacaucaaccugaugcccaucuga

SEQ ID NO: 75535 - RNA, 1413 nt, Artificial Sequence
  derived and/or modified sequence opt1 from neuraminidase__InfluenzaA__ABB80048
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcguggagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcagcggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccggcccugcuucugggucgagcuggugcgcgggcucccgaaggagaacaccaccaucuggacgagcggcuccagcaucuccuucugcggggugaacggcgacaccgccaacuggagcuggcccgacggcgccgagcugcccuucaccaucgacaaguga

SEQ ID NO: 75536 - RNA, 1410 nt, Artificial Sequence
  derived and/or modified sequence opt1 from neuraminidase__InfluenzaA__ABB80084
augaaccccaaccagaagaucaucaccaucggcagcgugucccugaccaucgccacgaucugcuuccucaugcagaucgccauccuggucaccaccgugacccugcacuucaagcaguacgagugcaacagcccguccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgccccguucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcacccccuaccggacccuccugaugaacgagcugggcgugccguuccaccucgggacgaagcaggucugcaucgccuggagcuccagcuccugccacgacggcaaggcguggcugcacgugugcgugaccgggcacgacgagaacgccaccgccagcuucaucuacgacggccgccugguggacuccaucgggagcugguccaagaagauccuccggacccaggagagcgagugcgucugcaucaacggcacgugcaccguggugaugaccgacggcuccgccagcgggcgcgcggacaccaagauccuguucaucgaggagggcaagaucguccacaucagccagcuguccgggagcgcccagcacguggaggagugcuccugcuacccccgguaccccggcgugcgcugcgucugccgggacaacuggaagggcagcaaccgccccaucguggacaucaacgugaaggaccacuccaucgucagcuccuacgugugcagcgggcucgugggcgacacgccgcggaagaacgacuccagcuccagcucccacugccugaaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggaccggggcaaccgcagcggguacuccggcaucuucagcgucgagggcaagagcugcaucaaccggugcuucuacguggagcugauccgcgggcggaagcaggagaccgaggugugguggacguccaacagcaucgucguguucugcggcaccuccgggaccuacggcaccgggagcuggcccgacggcgccgacaucaaccugaugccgaucuga

SEQ ID NO: 75537 - RNA, 1410 nt, Artificial Sequence; identical to SEQ ID NO: 75522
  derived and/or modified sequence opt1 from neuraminidase__InfluenzaA__ABB80095

SEQ ID NO: 75538 - RNA, 1410 nt, Artificial Sequence; identical to SEQ ID NO: 75522
  derived and/or modified sequence opt1 from neuraminidase__InfluenzaA__ABB80162

SEQ ID NO: 75539 - RNA, 1410 nt, Artificial Sequence; identical to SEQ ID NO: 75522
  derived and/or modified sequence opt1 from neuraminidase__InfluenzaA__ABB80199

SEQ ID NO: 75540 - RNA, 1410 nt, Artificial Sequence
  derived and/or modified sequence opt1 from neuraminidase__InfluenzaA__ABB80210
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucggccugaugcccaucuga

SEQ ID NO: 75541 - RNA, 1410 nt, Artificial Sequence
  derived and/or modified sequence opt1 from neuraminidase__InfluenzaA__ABB80232
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucgccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgcguggagcuccagcuccugccacgacgggaaggccuggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgcgagcggccgggccgacaccaagauccuguucaucgaggaggggaagaucguccacaucucccagcugagcggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcgacgacguguggaugggccggaccaucagcgagaagcugcgcuccggguacgagaccuucaaggucaucgagggcuggagcaagcccaacuccaagcuccagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggccggacggggccgacaucaaccugaugcccaucuga

SEQ ID NO: 75542 - RNA, 1410 nt, Artificial Sequence
  derived and/or modified sequence opt1 from neuraminidase__InfluenzaA__ABB80243
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccgccugguggacagcaucggguccuggagcaagaagauccuccggacccaggaguccgagugcgucugcaucaacggcacgugcaccguggugaugaccgacggcagcgccuccgggcgcgcggacaccaagauccuguucaucgaggagggcaagaucguccacaucagccagcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuccagcuccagccacugccugaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggaccggggcaaccgcuccggguacagcggcaucuucuccgucgagggcaagagcugcaucaaccggugcuucuacguggagcugauccgcgggcggaagaaggagaacgaggugugguggaccagcaacuccaucgucguguucugcggcacgagcgggaccuacggcaccggguccuggccggacggcgccgacaucaaccugaugcccaucuga

SEQ ID NO: 75543 - RNA, 1410 nt, Artificial Sequence
  derived and/or modified sequence opt1 from neuraminidase__InfluenzaA__ABB80254
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcggccccgacaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaagauccuccgcacccaggagagcgagugcgucugcaucaacggcaucugcacgguggugaugaccgacggcuccgccagcgggcgggcggacaccaagauccuguucaucgaggagggcaagaucguccacaucagcccccuguccgggagcgcccagcacguggaggagugcuccugcuacccccgcuacccgggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcucccacugccugaaccccaacaacgaggagggcgggcacggggucaagggcugggccuucgacgacggcaacgacguguggauggggcggaccaucagcgagaaguuccgcuccggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugugguggaccuccaacagcaucgucguguucugcggcacguccgggaccuacggcaccgggagcuggcccgacggcgccgacaucaaccugaugcccaucuga

SEQ ID NO: 75544 - RNA, 1410 nt, Artificial Sequence; identical to SEQ ID NO: 75135
  derived and/or modified sequence opt1 from neuraminidase__InfluenzaA__ABB80495

SEQ ID NO: 75545 - RNA, 1410 nt, Artificial Sequence; identical to SEQ ID NO: 75522
  derived and/or modified sequence opt1 from neuraminidase__InfluenzaA__ABB80506

SEQ ID NO: 75546 - RNA, 1410 nt, Artificial Sequence; identical to SEQ ID NO: 75522
  derived and/or modified sequence opt1 from neuraminidase__InfluenzaA__ABB80517

SEQ ID NO: 75547 - RNA, 1410 nt, Artificial Sequence; identical to SEQ ID NO: 75522
  derived and/or modified sequence opt1 from neuraminidase__InfluenzaA__ABB80532

SEQ ID NO: 75548 - RNA, 1410 nt, Artificial Sequence
  derived and/or modified sequence opt1 from neuraminidase__InfluenzaA__ABB80644
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaacaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 75549 - RNA, 1410 nt, Artificial Sequence
  derived and/or modified sequence opt1 from neuraminidase__InfluenzaA__ABB80664
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagguccuguucaucgaggaggggaagaucgugcacaucagcccccuguccggcagcgcccagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggagcaagccgaacuccaagcugcagaucaaccgccaggugaucgucgaccgggggaaccggagcggcuacuccgggaucuucagcguggagggcaagagcugcaucaaccgcugcuucuacguggagcucauccggggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 75550 - RNA, 1410 nt, Artificial Sequence
  derived and/or modified sequence opt1 from neuraminidase__InfluenzaA__ABB80675
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucgccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgcguggagcuccagcuccugccacgacgggaaggccuggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgcgagcggccgggccgacaccaagauccuguucaucgaggaggggaagaucguccacaucucccagcugagcggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcuccuacugccugaaccccaacaacgaggagggcgggcacggcgucaaggggugggccuucgacgacggcgacgacguguggaugggccggaccaucagcgagaagcugcgcuccggguacgagaccuucaaggucaucgagggcuggagcaagcccaacuccaagcuccagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggccggacggggccgacaucaaccugaugcccaucuga

SEQ ID NO: 75551 - RNA, 1410 nt, Artificial Sequence
  derived and/or modified sequence opt1 from neuraminidase__InfluenzaA__ABB80685
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccagcuccagcugccacgacggcaaggcguggcugcacgugugcgugacggggcacgacgagaacgccaccgccuccuucaucuacgacggccgccugguggacagcaucggguccuggagcaagaagauccuccggacccaggaguccgagugcgucugcaucaacgggaccugcacgguggugaugaccgacggcagcgccuccgggcgcgcggacaccaagauccuguucaucgaggagggcaagaucguccacaucagccagcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuccagcuccagccacugccugaaccccaacaacgaggagggcggccacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggaccggggcaaccgcuccggguacagcggcaucuucuccgucgagggcaagagcugcaucaaccggugcuucuacguggagcugauccgcgggcggaagcaggagaccgaggugugguggaccagcaacuccaucgucguguucugcggcacgagcgggaccuacggcaccggguccuggccggacggcgccgacaucaaccugaugcccaucuga

SEQ ID NO: 75552 - RNA, 1410 nt, Artificial Sequence; identical to SEQ ID NO: 75522
  derived and/or modified sequence opt1 from neuraminidase__InfluenzaA__ABB80696

SEQ ID NO: 75553 - RNA, 1410 nt, Artificial Sequence
  derived and/or modified sequence opt1 from neuraminidase__InfluenzaA__ABB80707
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcggccccgacaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaagauccuccgcacccaggagagcgagugcgucugcaucaacggcacgugcaccguggugaugaccgacggcuccgccagcgggcgggcggacaccaagauccuguucaucgaggagggcaagaucguccacaucagcccccuguccgggagcgcccagcacguggaggagugcuccugcuacccccgcuacccgggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcucccacugccugaaccccaacaacgaggagggcgggcacggggucaagggcugggccuucgacgacggcaacgacguguggauggggcggaccaucagcgagaaguuccgcuccggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugugguggacguccaacagcaucgucguguucugcggcaccuccgggaccuacggcaccgggagcuggcccgacggcgccgacaucaaccugaugcccaucuga

SEQ ID NO: 75554 - RNA, 1410 nt, Artificial Sequence; identical to SEQ ID NO: 75522
  derived and/or modified sequence opt1 from neuraminidase__InfluenzaA__ABB80716

SEQ ID NO: 75555 - RNA, 1410 nt, Artificial Sequence
  derived and/or modified sequence opt1 from neuraminidase__InfluenzaA__ABB80725
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacggucaucgagcgcaacaucaccgagaucguguaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgucagcugcgaccccgacaagugcuaccaguucgcccugggccaggggaccacgcugaacaaccgccacuccaacgacaccgugcacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcuggucgacuccaucggcagcugguccaagaagauccuccgcacccaggagagcgagugcgugugcaucaacgggacgugcaccguggucaugaccgacggcuccgccagcggccgggcggacaccaagauccuguucaucgaggaggggaagaucgugcacaucagcccccuguccggcagcgcccagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggagcaagccgaacuccaagcugcagaucaaccgccaggugaucgucgaccgggggaaccggagcggcuacuccgggaucuucagcguggagggcaagagcugcaucaaccgcugcuucuacguggagcucauccggggccgcaagcaggagaccgaggucugguggacguccaacagcaucguggccuucugcgggaccuccggcaccuacgggaccggcagcuggcccgacggggccgacaucaaccugaugcccaucuga

SEQ ID NO: 75556 - RNA, 1410 nt, Artificial Sequence
  derived and/or modified sequence opt1 from neuraminidase__InfluenzaA__ABB80740
augaaccccaaccagaagaucaucaccaucggcagcgugucccugaccaucgccacgaucugcuuccucaugcagaucgccauccuggucaccaccgugacccugcacuucaagcaguacgagugcugcagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaaguuccgcagcggguacgagaccuucaaggucaucgagggcugguccaagccgaacagcaagcugcagaucaaccgccaggugaucguggaccgggggaaccgguccggcuacagcgggaucuucuccgucgagggcaagagcugcaucaaccgcugcuucuacguggagcucauccggggccgcaagcaggagaccgaggugugguggacgagcaacuccaucgucgccuucugcgggaccagcggcaccuacgggaccggcuccuggcccgacggggccgacaucaaccugaugcccaucuga

SEQ ID NO: 75557 - RNA, 1410 nt, Artificial Sequence; identical to SEQ ID NO: 75522
  derived and/or modified sequence opt1 from neuraminidase__InfluenzaA__ABB80751

SEQ ID NO: 75558 - RNA, 1410 nt, Artificial Sequence; identical to SEQ ID NO: 75241
  derived and/or modified sequence opt1 from neuraminidase__InfluenzaA__ABB82186

SEQ ID NO: 75559 - RNA, 1413 nt, Artificial Sequence; identical to SEQ ID NO: 75404
  derived and/or modified sequence opt1 from neuraminidase__InfluenzaA__ABB82197

SEQ ID NO: 75560 - RNA, 1413 nt, Artificial Sequence; identical to SEQ ID NO: 75394
  derived and/or modified sequence opt1 from neuraminidase__InfluenzaA__ABB82208

SEQ ID NO: 75561 - RNA, 1413 nt, Artificial Sequence
  derived and/or modified sequence opt1 from neuraminidase__InfluenzaA__ABB82219
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugaucgcggagaaggacaagaccagcgugacccuggccgggaacuccagccugugcuccaucagcggcugggccaucuacaccaaggacaacuccauccggaucggcagcaagggggacgucuucgugauccgcgagccguucaucuccugcagcaaccucgagugccggacguucuuccugacccagggcgcccugcucaacgacaagcacuccaacgggaccgugaaggaccgcagccccuaccgggcccugauguccugcccccugggcgaggcgcccagcccguacaacagcaaguucgaguccgucgccuggagcgccuccgccugccacgacgggaugggcuggcucaccaucggcaucagcgggcccgacaacggcgcgguggccgugcugaaguacaacgggaucaucacggagaccaucaaguccuggaagaagcgcauccugcggacccaggagagcgagugcgucugcgugaacggcuccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggguacaucugcagcggcgucuucggcgacaacccccgccccaaggacggggagggcuccugcaacccggugacgguggacggggcggacggcgucaagggguucagcuacaaguacggcaacggcguguggaucgggcggaccaaguccaaccgccugcggaagggcuucgagaugaucugggaccccaacggguggaccgacaccgacagcgacuucuccgugaagcaggacgucguggccaucacggacuggagcggcuacagcggguccuucgugcagcaccccgagcucaccggccuggacugcauccgccccugcuucugggucgagcuggugcggggccucccgcgcgagaacaccaccaucuggacgagcggguccagcaucuccuucugcggcgucaacagcgacgccgccgacugguccuggcccgacggggccgagcugcccuucaccaucgacaaguga

SEQ ID NO: 75562 - RNA, 1410 nt, Artificial Sequence
  derived and/or modified sequence opt1 from neuraminidase__InfluenzaA__ABB82230
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggucugcaucgccugguccagcuccagcugccacgacggcaaggcguggcuccacgugugcgugaccggggacgacaagaacgccacggccuccuucaucuacgacggccggcuggucgacagcaucggguccuggagccagaacauccugcgcacccaggaguccgagugcgugugcaucaacgggaccugcaccguggucaugacggacggcagcgccuccggccgggcggacacccgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccaucguggacaucaacgugaaggacuacagcaucgacucccgguacgucugcagcgggcuggugggcgacacgccccgcaacaacgaccgguccagcaacuccaacugccgcaaccccaacaacgacaaggggaaccacggcgugaaggggugggccuucgacgacggcaacgacgucuggaugggccggaccaucagcaaggacucccgcagcggguacgagaccuucaaggugaucggcgggugguccaccccgaacagcaagucccagaucaaccggcaggucaucguggacagcgacaaccgcuccggcuacagcgggaucuucuccguggagggcaagagcugcaucaaccgcugcuucuacgucgagcucauccggggccgcgagcaggagacccgggugugguggaccagcaacuccaucguggucuucugcgggacgagcggcaccuacgggaccggcuccuggcccgacggggccgacaucaaccugaugcccaucuga

SEQ ID NO: 75563 - RNA, 1410 nt, Artificial Sequence
  derived and/or modified sequence opt1 from neuraminidase__InfluenzaA__ABB83018
augaaccccaaccagaagaucaucaccaucggcagcgugucccugaccaucgccacgaucugcuuccucacccagaucgccauccuggucaccaccgugacgcugcacuucaagcaguacgggugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggcuucgcccccuucagcaaggacaacuccauccgccucagcgccgggggcgacaucugggugacccgggagcccuacguguccugcgaccccgacaagugcuaccaguucgcccuggggcagggcacgacccugaacaacggccacagcaacgacaccguccacgaccgcaccccguaccggacgcuccugaugaacgagcugggggugcccuuccaccucggcaccaagcaggucugcaucgccugguccagcuccagcugccacgacgggaaggcguggcugcacgugugcgugaccggcgacgacaagaacgccaccgccuccuucaucuacaacgggcgccugguggacagcaucggcuccuggagcaagaagauccuccggacgcaggaguccgagugcgucugcaucaacgggaccugcaccguggugaugaccgacgggagcgccuccggcaaggcggacacgaagauccuguucaucgaggaggggaagaucguccacaccagccugcucagcggcuccgcccagcacguggaggagugcagcugcuacccccgcuaccccggcgugcggugcgucugccgcgacaacuggaagggguccaaccggccgaucguggacaucaacgugaaggacuacagcaucgucuccagcuacgugugcuccggccuggugggggacacgccccgcaagaacgacagcuccagcuccagccacugccuggaccccaacaacgaggagggcgggcacggcgucaagggcugggccuucgacgacgggaacgacguguggaugggccggaccaucuccgagaagcuccgcagcggguacgagaccuucaaggucaucgagggcugguccaagcccaacagcaagcugcagaucaaccgccaggugaucguggaccgggggaaccgguccggcuacagcggcaucuucuccgucgagggcaagagcugcaucaaccgcugcuucuacguggagcugauccggggccgcaaccaggagaccgaggugcucuggaccagcaacuccaucgucguguucugcgggaccagcggcacguacgggaccggcuccuggccggacggcgccgacaucaaccugaugcccaucuga

SEQ ID NO: 75564 - RNA, 1410 nt, Artificial Sequence; identical to SEQ ID NO: 75563
  derived and/or modified sequence opt1 from neuraminidase__InfluenzaA__ABB83029

SEQ ID NO: 75565 - RNA, 1410 nt, Artificial Sequence; identical to SEQ ID NO: 75390
  derived and/or modified sequence opt1 from neuraminidase__InfluenzaA__ABB83130

SEQ ID NO: 75566 - RNA, 1410 nt, Artificial Sequence
  derived and/or modified sequence opt1 from neuraminidase__InfluenzaA__ABB83141
augaaccccaaccagaagaucaucaccaucggcagcgugucccugaccaucgccacgaucugcuuccucagccagaucgccauccuggucaccaccgugacccugcacuucaagcaguacgagugcaacuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccagcuccugccacgacggcaaggcguggcugcacgugugcgugaccggggacgacaagaacgccaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggcggacaccaagauccuguucaucgaggagggcaagaucguccacacgagccugcucuccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcuggugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcuccgcuccggcuacgagaccuucaaggucaucgagggguggagcaagcccaacuccaagcugcagaucaaccgccaggugaucguggaccgggacaaccggagcggcuacuccgggaucuucagcgucgagggcaagagcugcaucaaccgcugcuucuacguggagcugauccggggccgcaaccaggagaccgaggugcucuggaccuccaacagcaucgucguguucugcgggaccuccggcaccuacgggacgggcagcuggccggacggggccgacaucaaccugaugcccaucuga

SEQ ID NO: 75567 - RNA, 1410 nt, Artificial Sequence
  derived and/or modified sequence opt1 from neuraminidase__InfluenzaA__ABB86876
augaacaccaaccagcgcaucaucaccaucggcacggugugccugaucgucgggaucaucagccuccugcugcagaucggcaacaucgugucccucuggaucagccacuccauccagaccgggggcaagaaccacagcgagaugugcaaccagaacgugaucaccuacgucaacaacaccugggugaaccggacguacgugaacaucuccaacaccaacaucgccaccguccaggacgugaccagcgugauccuggccgggaacuccagccugugcuccgucagcggcugggcgaucuacuccaaggacaacagcauccgcaucggcuccaagggggacaucuucgugauccgggagcccuucaucagcugcucccaccucgagugccgcacguucuuccugacccagggcgcccugcucaacgacaagcacagcaacgggaccgugaaggaccgguccccguaccgcacccugaugagcugccccaucggcgaggcccccucccccuacaacagccgguucgagagcgucgccugguccgccagcgcgugccacgacgggaugggcuggcugacgaucggcaucuccgggccggacaacggcgccguggccgugcucaaguacaacgggaucaucaccgacaccaucaagagcuggcgcaacaagauccugcggacccaggaguccgagugcgucugcaugaacggcagcugcuucacggugcugaccgacggccccuccaacgggcaggccagcuacaagaucuucaagguggagaagggcaagaucaucaaguccaucgagcucgacgcgcccaacuaccacuacgaggagugcagcugcuaccccgacaccgggaaggucaugugcgugugccgcgacaacuggcacgccuccaaccggccgugggugagcuucgaccagaaccuggacuaccagaucggcuacaucugcuccggggucuucggcgacaacccccgcagcaacgacggcaaggggaacugcggccccgugcuguccaacggggccaacggcgugaagggguucagcuuccgguacggcaacggcgucuggaucgggcgcaccaaguccaucaacagccgguccggcuucgagaugaucugggaccccaacggguggacgggcaccgacagcagcuucuccaugaagcaggacaucaucgcccucaccgacuggagcggguacuccggcagcuucgugcagcacccggagcugaccggcaugaacugcauccgccccugcuucugggucgagcugauccgggggcagcccaaggaguccacgaucugggccagcggcuccagcaucuccuucugcgggguggacagcgagaccaccuccuggagcuggcccgacggcgcggaccucccguucaccaucgacaaguga

SEQ ID NO: 75568 - RNA, 1410 nt, Artificial Sequence
  derived and/or modified sequence opt1 from neuraminidase__InfluenzaA__ABB86886
augaacaccaaccagcgcaucaucaccaucggcacggccugccuggccaucgggaucgugagccuccugcugcagaucggcaacaucgucucccucuggaucagccacuccauccagaccgaggagaagaaccacagcgagaccugcucccagaacuucaucacccacgagaacaacacgugggugaaccagaccuacaucaacaucagcaacaccaacaacguggucgggcagggcgugaccuccaucaugcuggcggggaacagcucccugugccccaucagcggcugggccaucuacuccaaggacaacagcauccggaucggcuccaagggggacaucuucgugauccgcgagccguucaucagcugcucccaccucgagugccggacguucuuccugacccagggcgcccugcucaacgacaagcacagcaacgggaccgucaaggaccgcucccccuaccggacccugaugagcugccccaucggcgaggcccccuccccguacaacagccgcuucgagagcguggccugguccgcgagcgccugccacgacgggaugggcuggcugacgaucggcaucuccgggcccgacaacggcgccguggccgucuucaaguacaacgggaucaucaccgacaccaucaagagcuggcggaacaagauccuccgcacccaggaguccgagugcgugugcaucaacggcagcugcuucacgaucaugaccgacggccccuccaacgggcaggcgagcuacaagaucuucaagauggagaagggcaagaucaucaaguccguggagcuggacgcccccaacuaccacuacgaggagagcuccugcuacccggacaccgggaaggucgugugcgugugccgggacaacuggcacgccagcaaccgccccugggucuccuucgaccagaaccuggacuaccagaucggcuacaucugcagcgggguguucggcgacaacccccgguccaacgacggcaaggggaacugcggccccgugcucagcaacggggccaacggcgucaaggagguguccuuccgcuacgggaacggcguguggaucggccggaccaagagcaucuccagccgcagcggguucgagaugaucugggacccgaacggcuggacggagaccgacuccagcuucuccaucaagcaggacaucaucgcccugaccgacuggagcggguacuccggcagcuucguccagcaccccgagcugaccgggaugaacugcaucaagcccugcuucuggguggagcucauccggggccagcccaaggaguccacgaucuggaccagcggcuccagcaucuccuucugcgggguggacagcgagaccgcguccuggagcuggccggacggcgccgaccugcccuucaccaucgacaaguga

SEQ ID NO: 75569 - RNA, 1410 nt, Artificial Sequence
  derived and/or modified sequence opt1 from neuraminidase__InfluenzaA__ABB86898
augaaccccaaccagaagaucaucaccaucggcagcgugucccugacccucgccacgaucugcuuccugaugcagaucgccauccuggucaccaccgugacccuccacuucaagcagcaggagugcaacagcccgcccaacaaccaggugaugcugugcgagcccacgaucaucgagcgcaacaucaccgagaucgucuaccugaccaacaccacgaucgagaaggagaucugccccaagcucgcggaguaccggaacugguccaagccgcagugcaacaucaccggguucgcccccuucagcaaggacaacuccauccgccugagcgccggcggggacaucugggugacccgggagcccuacguguccugcgaccccgacaagugcuaccaguucgcccugggccaggggaccacgcucaacaacggccacagcaacaacaccguccacgaccgcaccccguaccggacccugcugaugaacgagcucggcgugcccuuccaccuggggacgcgccaggugugcaucgccugguccagcuccagcugccacgacggcaaggcguggcugcacgucugcaucaccggggacgacaagaacgccaccgccuccuucaucuacaacggccggcucguggacagcaucggguccuggagcaagaagauccugcgcacccaggaguccgagugcgugugcaucaacggcacgugcaccgucgugaugaccgacggcagcgccuccgggaaggcggacaccaagauccuguucaucgaggagggcaagaucgugcacaucagcacgcucagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcuggugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcuccgguccggcuacgagaccuucaaggugaucgagggguggagcaagcccaacuccaagcugcagaucaaccgccaggucaucguggagcggggcagccgcuccggguacagcggcaucuucuccguggagggcaagagcugcaucaaccggugcuucuacgucgagcugauccgcgggcggaaggaggagaccaaggugugguggaccagcaacuccaucguggucuucugcggcaccagcgggaccuacggcacgggguccuggccggacggcgccgacaucaaccucaugcccaucuga

SEQ ID NO: 75570 - RNA, 1410 nt, Artificial Sequence
  derived and/or modified sequence opt1 from neuraminidase__InfluenzaA__ABB86906
augaacaccaaccagcgcaucaucaccaucggcacggugugccugaucgucgggaucaucagccuccugcugcagaucggcaacaucgugucccucuggaucagccacuccauccagaccgggggcaagaaccacagcgagaugugcaaccagaacgugaucaccuacgucaacaacaccugggugaaccggacguacgugaacaucuccaacaccaacaucgccaccguccaggacgugaccagcgugauccuggccgggaacuccagccugugcuccgucagcggcugggcgaucuacuccaaggacaacagcauccgcaucggcuccaagggggacaucuucgugauccgggagcccuucaucagcugcucccaccucgagugccgcacguucuuccugacccagggcgcccugcucaacgacaagcacagcaacgggaccgugaaggaccgguccccguaccgcacccugaugagcugccccaucggcgaggcccccucccccuacaacagccgguucgagagcgucgccugguccgccagcgcgugccacgacgggaugggcuggcugacgaucggcaucuccgggccggacaacggcgccguggccgugcucaaguacaacgggaucaucaccgacaccaucaagagcuggcgcaacaagauccugcggacccaggaguccgagugcgucugcaugaacggcagcugcuucacggugcugaccgacggccccuccaacgggcaggccagcuacgagaucuucaagguggagaagggcaagaucaucaaguccaucgagcucgacgcgcccaacuaccacuacgaggagugcagcugcuaccccgacaccgggaaggucaugugcgugugccgcgacaacuggcacgccuccaaccggccgugggugagcuucgaccagaaccugaacuaccagaucggcuacaucugcuccggggucuucggcgacaacccccgcagcaacgacggcaaggggaacugcggccccgugcuguccaacggggccaacggcgugaagggguucagcuuccgguacggcaacggcgucuggaucgggcgcaccaaguccaucagcucccggagcggcuucgagauggugugggaccccaacggguggacgggcaccgacagccgcuucuccaugaagcaggacaucaucgcccucaccgacuggagcggguacuccggcagcuucguccagcacccggagcugaccggcaugaacugcauccggcccugcuucuggguggagcugauccgcgggcagcccaaggaguccacgaucugggccagcggcuccagcaucuccuucugcggggugaacagcgagaccgcguccuggagcuggcccgacggcgccgaccucccguucaccaucgacaaguga

SEQ ID NO: 75571 - RNA, 1410 nt, Artificial Sequence
  derived and/or modified sequence opt1 from neuraminidase__InfluenzaA__ABB86916
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcaucaccggggacgacaagaacgccaccgccuccuucaucuacaacggccgccugguggacagcaucuccagcugguccaagaagauccuccggacgcaggagagcgagugcgugugcaucaacgggaccugcaccgucgugaugaccgacggcuccgccagcggcaaggcggacacgaagauccuguucaucgaggaggggaagaucgugcacaccagccugcucuccggcagcgcccagcacgucgaggagugcuccugcuacccccgcuaccccggggugcggugcgugugccgcgacaacuggaagggcagcaaccggccgaucgucgacaucaacgugaaggacuacuccaucgugagcuccuacgucugcagcggccuggugggggacacgccccgcaagaacgacuccagcuccagcucccacugccuggaccccaacaacgaggagggcgggcacggcgugaaggggugggccuucgacgacggcaacgacgucuggaugggccggaccaucagcgagaagcuccgcuccggguacgagaccuucaaggugaucgagggcuggagcaagcccaacuccaagcugcagaucaaccggcaggucaucguggaccgcgacaaccggagcggguacuccggcaucuucagcguggagggcaagagcugcaucaaccgcugcuucuacgucgagcugauccgggggcgcaaccaggagaccgaggugcucuggaccuccaacagcaucguggucuucugcggcaccuccgggacguacggcaccgggagcuggccggacggcgccgacaucaaccugaugcccaucuga

SEQ ID NO: 75572 - RNA, 1410 nt, Artificial Sequence
  derived and/or modified sequence opt1 from neuraminidase__InfluenzaA__ABB86928
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcaucaccggggacgacaagaacgccaccgccuccuucaucuacaacggccggcugguggacagcaucggguccuggagcaagaagauccuccgcacccaggaguccgagugcgugugcaucaacggcacgugcaccgucgugaugaccgacggcagcgccuccgggaaggcggacaccaagauccuguucaucgaggagggcaagaucgugcacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccugaaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcaucgagggcaaguccugcaucaaccggugcuucuacguggagcugauccgcgggcggaaggaggagaccaaggucugguggaccagcaacagcaucgugguguucugcggcaccuccgggaccuacggcacggggagcuggccggacggcgccgacaucaaccugaugcccaucuga

SEQ ID NO: 75573 - RNA, 1410 nt, Artificial Sequence
  derived and/or modified sequence opt1 from neuraminidase__InfluenzaA__ABB86936
augaacaccaaccagcgcaucaucaccaucggcacggugugccugaucgucgggaucaucagccuccugcugcagaucggcaacaucgugucccucuggaucaaccacagcauccagaccgaggggaagaaccacuccgagaugugcaaccagaacgugaucaccuacgucaacaacaccugggugaaccggacguacgugaacaucagcaacaccaacaucgccaccguccaggacgugaccuccgugauccuggccggcaacagcucccugugccccgucagcgggugggcgaucuacuccaaggacaacagcauccgcaucggcuccaagggcgacaucuucgugauccgggagccguucaucagcugcucccaccucgagugccgcacguucuuccugacccagggggcccugcucaacgacaagcacagcaacggcaccgugcgggaccgcucccccuaccggacccugaugagcugccccacgggggaggcccccuccccguacaacagccgcuucgaguccgucgccuggagcgccagcgcgugccacgacggcaugggguggcugaccaucggcaucuccggccccgacaacggggccguggccgugcucaaguacaacggcaucaucaccgacaccaucaagagcuggcggaacaagauccugcgcacgcaggaguccgagugcgucugcaugaacgggagcugcuucaccgugcugaccgacggccccuccaacggccaggccagcuacaagaucuucaagguggagaaggggaagaucaucaaguccaucgagcucgacgcgcccaacuaccacuacgaggagugcagcugcuacccggacaccggcaaggucaugugcgugugccgggacaacuggcacgccuccaaccgccccuggaucuacuucgaccagaaccuggacuaccagaucggguacaucugcagcggcguguucggggacaacccccgguccaacgacggcaagggcaacugcgggcccguccugagcaacggcgccaacggggugaagggcuucuccuuccgcuacgggaacggcguguggaucggccggaccaagagcaucaacucccgcagcggguucgagaugaucugggacccgaacggcuggacggggaccgacuccagcuucuccaugaagcaggacauccucgccaccacggacuggagcggcuacagcggguccuucguccagcaccccgagcugaccggcaugaacugcauccggcccugcuucuggguggagcugauccgcggccagcccaaggagagcaccaucugggccuccgggagcuccaucagcuucugcggcgucaacuccgagaccgcgaacuggagcuggccggacggggccgaccuccccuucacgaucgacaaguga

SEQ ID NO: 75574 - RNA, 1410 nt, Artificial Sequence
  derived and/or modified sequence opt1 from neuraminidase__InfluenzaA__ABB86947
augaacaccaaccagcgcaucaucaccaucggcacggugugccugaucgucgggaucaucagccuccugucccagaucggcaacaucgugagccuguggaucauccacuccauccagaccgggggcaagaaccacagcgagaugugcaaccagaacgugaucaccuacgucaacaacaccugggugaaccggacguacaucaacaucuccaacaccaacaucgccaccgugaaggacgucaccagcgugauccucgccgggaacuccagccugugccccguguccggcugggcgaucuacagcaaggacaacuccauccgcaucggcagcaagggggacaucuucgucauccgggagccguucaucuccugcagccaccuggagugccgcacguucuuccucacccagggcgcccugcugaacgacaagcacuccaacgggaccgugaaggaccggagccccuaccgcacccucauguccugccccaucggcgaggcccccagcccguacaacucccgguucgagagcguggccuggagcgccuccgcgugccacgacgggaugggcuggcugacgaucggcaucagcgggcccgacaacggcgccgucgccgugcugaaguacaacgggaucaucaccgacaccaucaaguccuggcgcaacaagauccuccggacccaggagagcgagugcgugugcaugaacggcuccugcuucacgguccugaccgacggccccagcaacgggcaggccuccuacaagaucuucaagguggagaagggcaagaucaucaagagcaucgagcuggacgcgcccaacuaccacuacgaggagugcuccugcuacccggacgccgggaaggugaugugcgucugccgcgacaacuggcacgccagcaaccggcccuggguguccuucgaccagaaccucgacuaccagaugggcuacaucugcagcgggguguucggcgacaacccccgcuccaacgacggcaaggggaacugcggccccguccugagcaacggggccaacggcgugaagggguucuccuuccgguacggcaacggcguguggaucgggcgcaccaagagcaucaacucccggagcggcuucgagaugaucugggacccgaacggguggaccggcacggacuccagcuucagcaugaagcaggacaucaucgcccugaccgacugguccggguacagcggcuccuucguccagcaccccgagcucaccggcaugaacugcauccgccccugcuucuggguggagcugauccgggggcagcccaaggagagcaccaucugggcguccggcagcuccaucagcuucugcggggucaacuccgagacggccagcugguccuggccggacggcgccgaccugcccuucaccaucgacaaguga

SEQ ID NO: 75575 - RNA, 1410 nt, Artificial Sequence
  derived and/or modified sequence opt1 from neuraminidase__InfluenzaA__ABB86957
augaacaccaaccagcgcaucaucaccgugggcacggucugccugaucguggggaucgugagccuccugcugcagaucggcaacaucgucucccucuggaucagccacuccauccagaccggggagaagaaccacagcgaggugugcaaccagaacaucaucaccuacgagaacaagaccugggugaaccagacguacgucaacaucuccaacaccaacaucgccgagggccagggggugaccagcaucaucauggccggcaacuccagccugugccccguguccggcugggcgaucuacagcaaggacaacuccauccggaucgggagcaagggcgacaucuucgucauccgcgagccguucaucuccugcagccaccuggagugccggaccuucuuccucacgcagggggcccugcugaacgaccgccacuccaacggcaccgugaaggaccggagccccuaccgcacccucauguccugccccaucggggaggcccccagcccguacaacucccgguucgagagcguggccuggagcgccuccgcgugccacgacggcaugggcuggcugaccaucgggaucagcggcuccgacaacgaggccgucgccgugcugaaguacaacgggaucaucacggacaccaucaagagcuggcgcaacaagauccuccggacccaggaguccgagugcgugugcaucaacggcagcugcuucaccaucaugacggacggccccuccaacgggcaggccagcuacaagaucuucaagauggagaagggcaagaucaucaaguccgucgagcuggaggcgcccaacuaccacuacgaggagugcagcugcuaccccgacaccgggaagguggugugcgucugccgcgacaacuggcacgccuccaaccggccgugggugagcuucaaccagaaccuggacuaccagaucggcuacaucugcuccgggguguucggcgacaacccccgcagcaacgacggcaaggggaacugcggccccguccccuccaacggggccaacggcgugaagggguucagcuuccgguacggcaacggcguguggaucgggcgcaccaaguccaucuucagccgguccggcuucgagaugaucugggacccgaacggguggaccgagacggacagcagcuucuccaucaagcaggacaucaucgcccucaccgacuggagcggcuacuccgggagcuucguccagcaccccgagcugaccggcaugaacugcauccgccccugcuucuggguggagcugauccggggccagcccaaggaguccaccaucuggacgagcggguccagcaucuccuucugcggcgucgacagcgagaccgccuccuggagcuggccggacggggcggaccuccccuucaccaucgacaaguga

SEQ ID NO: 75576 - RNA, 1410 nt, Artificial Sequence
  derived and/or modified sequence opt1 from neuraminidase__InfluenzaA__ABB96333
augaaccccaaccagaagaucaucaccaucggcagcgugucccugaccaucgccacgaucugcuuccucaugcagaucgccauccuggucaccaccgugacccugcacuucaagcaguacgacugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagcaagaacauccugcgcacccaggaguccgagugcgucugcaucaacgggaccugcacgguggugaugaccgacggcagcgccuccgagcgggcggacaccaagauccucuucaucgaggaggggaagaucguccacaucagcccccugagcggcuccgcccagcacguggaggagugcagcugcuacccccgcuacccgggggugcggugcgucugccgcgacaacuggaagggcuccaaccggcccgugguggacaucaacgucaaggacuacagcaucgccuccagcuacgugugcuccggccuggugggggacacgccccgcaagaacgaccgguacagcuccagcuacugccgcaaccccaacaacgagaagggcaaccacggggucaagggcugggccuucgacgacgggaacgacguguggaugggccggaccaucuccgacgagagccgcuccggcuacgagaccuucaaggucaucgggggcuggagcaccccgaacuccaagcuccagaucaaccgccaggugaucguggacagcgacaaccgguccggguacagcggcaucuucuccgucgagggcaagagcugcaucaaccggugcuucuacguggagcugauccgcggccgcgagcaggagacccgggugugguggacgagcaacuccaucgucguguucugcggcaccagcgggaccuacggcaccggguccuggcccgacggcgccgacaucaaccugaugcccaucuga

SEQ ID NO: 75577 - RNA, 1410 nt, Artificial Sequence
  derived and/or modified sequence opt1 from neuraminidase__InfluenzaA__ABB96344
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggccgcugcuaccaguucgcccucgggcagggcaccacccuggacaacaagcacagcaacgacacgauccacgaccggaccccgcaccgcacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagcaagaacauccugcggacccaggaguccgagugcgucugcaucaacgggaccugcacgguggugaugaccgacggcagcgccuccgagcgcgcggacaccaagguccucuucaucgaggaggggaagaucgugcacaucagcccccugagcggcuccgcccagcacguggaggagugcagcugcuacccccgguacccggggguccgcugcgugugccgggacaacuggaagggcuccaaccgccccguggucgacaucaacgugaaggacuacagcaucgccuccagcuacgugugcuccggccuggucggggacacgccccggaagaacgaccgcuacagcuccagcuacugccggaaccccaacaacgagaagggcaaccacggggugaagggcugggccuucgacgacgggaacgacgucuggaugggccgcaccaucuccgacgagagccgguccggcuacgagaccuucaaggugaucgggggcuggagcaccccgaacuccaagcuccagaucaaccgccaggugaucgucgacagcgacaaccgguccggguacagcggcaucuucuccguggagggcaagagcugcaucaaccgcugcuucuacguggagcugauccgcggccgggagcaggagacccgcgucugguggacgagcaacuccaucgugguguucugcggcaccagcgggaccuacggcaccggguccuggcccgacggcgccgacaucaaccugaugcccaucuga

SEQ ID NO: 75578 - RNA, 1410 nt, Artificial Sequence
  derived and/or modified sequence opt1 from neuraminidase__InfluenzaA__ABB96398
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagacgugccccaagcugguggaguaccggaacugguccaagccgcagugcaagaucaccggguucgcccccuucagcaaggacaacuccauccgccugagcgccggcggggacaucugggugacccgggagcccuacgucuccugcgaccccggcaagugcuaccaguucgcccucgggcagggcaccacgcuggacaacaagcacagcaacgacaccauccacgaccgcaccccguaccggacccugcucaugaacgagcugggcgugcccuuccaccuggggacgcgccaggugugcaucgccugguccagcuccagcugccacgacggcaaggcguggcuccacgucugcgugaccggguacgacaagaacgccaccgccuccuucaucuacgacggccggcugguggacagcaucggguccuggagcaagaacauccugcgcacccaggaguccgagugcgucugcaucaacggcacgugcaccguggugaugaccgacggcagcgccuccgagcgggcggacaccaagauccucuucaucgaggaggggaagaucguccacaucagcccccugagcggcuccgcccagcacguggaggagugcagcugcuacccccgcuacccgggggugcggugcgucugccgcgacaacuggaagggcuccaaccggcccgugguggacaucaacgucaaggacuacagcaucgccuccagcuacgugugcuccggccuggugggggacacgccccgcaagaacgaccggagcuccagcuccuacugccgcaaccccaacaacgagaagggcaaccacggggucaagggcugggccuucgacgacgggaacgacguguggaugggccggaccaucagcgaggagucccgcagcggcuacgagaccuucaaggucaucgggggcugguccaccccgaacagcaagcuccagaucaaccgccaggugaucguggacuccgacaaccggagcggguacuccggcaucuucagcgucgagggcaagagcugcaucaaccggugcuucuacguggagcugauccgcgggcgcgagcaggagacgcgggugugguggaccuccaacagcaucgucguguucugcggcaccuccgggaccuacggcacggggagcuggcccgacggcgccgacaucaaccugaugcccaucuga

SEQ ID NO: 75579 - RNA, 1410 nt, Artificial Sequence; identical to SEQ ID NO: 75390
  derived and/or modified sequence opt1 from neuraminidase__InfluenzaA__ABB96490

SEQ ID NO: 75580 - RNA, 1410 nt, Artificial Sequence
  derived and/or modified sequence opt1 from neuraminidase__InfluenzaA__ABB96501
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccguccaagugcuaccaguucgcccucggccaggggaccacccuggacaacaagcacagcaacgacacgauccacgaccgcacgccccaccggacccugcucaugaacgagcugggcgugcccuuccaccugggcacccgccaggugugcaucgccugguccagcuccagcugccacgacgggaaggccuggcuccacgucugcgugaccggcuacgacaagaacgcgaccgccuccuucaucuacgacgggcggcugguggacagcaucggcuccuggagcaagaacauccugcgcacccaggaguccgagugcgucugcaucaacgggaccugcacgguggugaugaccgacggcagcgccagcgagcgggccgacaccaagauccucuucaucgaggagggcaagaucguccacaucagcccccuguccggguccgcgcagcacguggaggagugcagcugcuacccgcgcuaccccggcgugcggugcgucugccgcgacaacuggaagggguccaaccggcccgugguggacaucaacgucaaggacuacagcaucguguccagcuacgugugcuccggccuggucggcgacacgccccgcaagaacgaccggagcuccagcuccuacugccgcaacccgaacaacgagaaggggaaccacggcgugaaggggugggccuucgacgacggcaacgacgucuggauggggcggaccaucagcgaggagucccgcagcggcuacgagaccuucaaggugaucggcgggugguccacccccaacagcaagucccagaucaaccgccaggugaucgucgacagcggcaaccggagcggguacuccggcaucuucagcguggaggggaaguccugcaucaaccggugcuucuacguggagcucauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 75581 - RNA, 1410 nt, Artificial Sequence
  derived and/or modified sequence opt1 from neuraminidase__InfluenzaA__ABB96534
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 75582 - RNA, 1410 nt, Artificial Sequence
  derived and/or modified sequence opt1 from neuraminidase__InfluenzaA__ABC02237
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagccagcuguccggcagcgcccagcacguggaggagugcuccugcuacccccgcuaccccggggugcggugcgucugccgcgacaacuggaagggcagcaaccggccgaucguggacaucaacaucaaggacuacuccaucgugagcuccuacgucugcagcggccucgugggggacacgccccgcaagaacgacuccagcuccagcucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggagcaagcccaacuccaagcugcagaucaaccggcaggucaucguggaccgcgggaaccggagcggcuacuccgggaucuucagcguggagggcaagagcugcaucaaccgcugcuucuacgucgagcucauccggggccgcaagcaggagaccgaggugugguggacguccaacagcaucguggccuucugcgggaccuccggcaccuacgggaccggcagcuggccggacggggccgacaucaaccugaugcccaucuga

SEQ ID NO: 75583 - RNA, 1410 nt, Artificial Sequence
  derived and/or modified sequence opt1 from neuraminidase__InfluenzaA__ABC02258
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccagaucaugcccugcgagcccacgaucaucgagcgcaacaucaccgagaucguguaccucaccaacaucaccaucgagaaggagaucugccccaagcuggucgaguaccggaacugguccaagccgcagugcaagaucacgggguucgcccccuucagcaaggacaacuccauccgccugagcgccggcggggacaucugggugacccgggagcccuacguguccugcgaccccagcaagugcuaccaguucgcccucggccaggggaccacccuggacaacaagcacuccaacgacacgauccacgaccgcaccccgcaccggacccugcucaugaacgagcugggcguccccuuccaccugggcacccgccaggugugcaucgccuggagcuccagcuccugccacgacgggaaggcguggcuccacgugugcgucacgggcuacgacaagaacgccaccgccagcuucaucuacgacgggcggcugguggacuccaucggcagcuggucccagaacauccugcgcacccaggagagcgagugcgugugcaucaacgggaccugcacggucgugaugaccgacggcuccgccagcggccgggcggacaccaagauccucuucaucgaggaggggaagaucgugcacaucagcccccuguccggcagcgcccagcacgucgaggagugcuccugcuacccccgcuacccgggggugcggugcaucugccgcgacaacuggaagggcagcaaccggcccguggucgacaucaacgugaaggacuacuccaucgacagcuccuacgugugcagcggccuggucggggacacgccccgcaagaacgaccgguccagcaacuccuacugccgcaaccccaacaacgagaagggcaaccacggggugaagggcugggccuucgacgacgggaacgacguguggaugggccggaccaucagcgaggacucccgcagcggcuacgagaccuucaaggucaucgggggcugguccaccccgaacagcaagcuccagaucaaccgccaggugaucgucgacuccgacaaccggagcggguacuccggcaucuucagcguggagggcaagagcugcaucaaccggugcuucuacguggagcugauccgcgggcgcgagcaggagacccgggucugguggacguccaacagcaucgugguguucugcggcaccuccgggaccuacggcgccgggagcuggcccgacggcgccgacaucaaccugaugcccaucuga

SEQ ID NO: 75584 - RNA, 1410 nt, Artificial Sequence
  derived and/or modified sequence opt1 from neuraminidase__InfluenzaA__ABC02269
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggacccacggcgugaaggggugggccuucgacgacggcaacgacgucuggaugggccggaccaucagcgaggacucccgcagcggguacgagaccuucaaggugaucggcgggugguccacgccgaacagcaagcuccagaucaaccggcaggucaucguggacuccgacaaccgcagcggcuacuccgggaucuucagcguggagggcaagagcugcaucaaccggugcuucuacgucgagcugauccgcggccgcgagcaggagacccgggugugguggaccuccaacagcaucguggucuucugcgggaccuccggcacguacgggaccggcagcuggcccgacggggccgacaucaaccugaugcccaucuga

SEQ ID NO: 75585 - RNA, 1413 nt, Artificial Sequence
  derived and/or modified sequence opt1 from neuraminidase__InfluenzaA__ABC02280
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccaggggucccugcucaacgacaagcacagcaacggcaccgucaaggaccgcucccccuaccgggcccugaugagcugcccccugggggaggcccccagcccguacaacuccaaguucgagagcguggcgugguccgccagcgccugccacgacggcaugggcuggcucaccaucgggaucuccggccccgacaacggggccguggcgguccugaaguacaacggcaucaucacggagaccaucaagagcuggaagaagcagauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcgaggggagcugcaacccggugacggucgacggcgccaacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggcgaucacggacuggagcggguacuccggcagcuucguccagcaccccgagcucaccggccuggacugcauccggcccugcuucuggguggagcugguccgcgggcucccgaaggagaacaccaccaucuggacguccggcagcuccaucagcuucugcggggugaacuccgacaccgccaacuggagcuggcccgacggcgccgagcugcccuucaccaucgacaaguga

SEQ ID NO: 75586 - RNA, 1410 nt, Artificial Sequence; identical to SEQ ID NO: 75581
  derived and/or modified sequence opt1 from neuraminidase__InfluenzaA__ABC02302

SEQ ID NO: 75587 - RNA, 1410 nt, Artificial Sequence; identical to SEQ ID NO: 75578
  derived and/or modified sequence opt1 from neuraminidase__InfluenzaA__ABC02313

SEQ ID NO: 75588 - RNA, 1410 nt, Artificial Sequence; identical to SEQ ID NO: 75583
  derived and/or modified sequence opt1 from neuraminidase__InfluenzaA__ABC02324

SEQ ID NO: 75589 - RNA, 1410 nt, Artificial Sequence
  derived and/or modified sequence opt1 from neuraminidase__InfluenzaA__ABC02335
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucaaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggacgagcaacuccaucguggucuucugcgggaccagcggcaccuacgggaccggcuccuggcccgacggggccgacaucaaccugaugcccaucuga

SEQ ID NO: 75590 - RNA, 1410 nt, Artificial Sequence
  derived and/or modified sequence opt1 from neuraminidase__InfluenzaA__ABC39808
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccguccaagugcuaccaguucgcccucggccaggggaccacccuggacaacaagcacagcaacgacacgauccacgaccgcacgccccaccggacccugcucaugaacgagcugggcgugcccuuccaccugggcacccgccaggugugcaucgccugguccagcuccagcugccacgacgggaaggccuggcuccacgucugcgugaccggcuacgacaagaacgcgaccgccuccuucaucuacgacgggcggcugguggacagcaucggcuccuggagcaagaacauccugcgcacccaggaguccgagugcgucugcaucaacgggaccugcacgguggugaugaccgacggcagcgccagcgagcgggccgacaccaagauccucuucaucgaggagggcaagaucguccacaucagcccccuguccggguccgcgcagcacguggaggagugcagcugcuacccgcgcuaccccggcgugcggugcgucugccgcgacaacuggaagggguccaaccggcccgugguggacaucaacgucaaggacuacagcaucguguccagcuacgugugcuccggccuggucggcgacacgccccgcaagaacgaccggagcuccagcuccuacugccgcaacccgaacaacgagaagggggaccacggcgugaaggggugggccuucgacgacggcaacgacgucuggauggggcggaccaucagcgaggagucccgcagcggcuacgagaccuucaaggugaucggcgggugguccacccccaacagcaagucccagaucaaccgccaggugaucgucgacagcggcaaccggagcggguacuccggcaucuucagcguggaggggaaguccugcaucaaccggugcuucuacguggagcucauccgcggccgcaagcaggagacccgggucugguggacgagcaacuccaucgugguguucugcggcaccagcgggaccuacggcaccggguccuggcccgacggcgccgacaucaaccugaugcccaucuga

SEQ ID NO: 75591 - RNA, 1410 nt, Artificial Sequence; identical to SEQ ID NO: 75390
  derived and/or modified sequence opt1 from neuraminidase__InfluenzaA__ABC40525

SEQ ID NO: 75592 - RNA, 1413 nt, Artificial Sequence
  derived and/or modified sequence opt1 from neuraminidase__InfluenzaA__ABC40536
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaucaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccgacaccgacagcgacuucuccgucaagcaggacgugguggccaucaccgacuggagcggguacagcggcuccuucguccagcaccccgagcucacgggccuggacugcauccggcccugcuucuggguggagcugguccgcgggcucccgaaggagaacaccaccaucuggaccagcggcuccagcaucuccuucugcggggugaacagcgacacggccaacugguccuggcccgacggcgccgagcugcccuucaccaucgacaaguga

SEQ ID NO: 75593 - RNA, 1410 nt, Artificial Sequence; identical to SEQ ID NO: 75584
  derived and/or modified sequence opt1 from neuraminidase__InfluenzaA__ABC40547

SEQ ID NO: 75594 - RNA, 1410 nt, Artificial Sequence
  derived and/or modified sequence opt1 from neuraminidase__InfluenzaA__ABC40558
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacggggcacgacaagaacgcgaccgccagcuucaucuacgacggccggcugguggacuccaucgggagcugguccaagagcauccugcgcacccaggaguccgagugcgucugcaucaacgggaccugcacgguggugaugaccgacggcagcgccagcgagcgggccgacaccaagauccucuucaucgaggagggcaagaucguccacaucagcccccuguccggcuccgcgcagcacguggaggagugcagcugcuacccgcgcuaccccggggugcggugcgucugccgcgacaacuggaagggcuccaaccggcccgugguggacaucaacgucaaggacuacagcaucguguccagcuacgugugcuccggccuggucggggacacgccccgcaagaacgaccggagcuccagcuccuacugccagaacccgaacaacgagaagggcaaccacggggugaagggcugggccuucgacgacgggaacgacgucuggaugggccgcaccaucagcgaggagucccggagcggcuacgagaccuucaaggugaucgggggcugguccacccccaacagcaagcuccagaucaaccgccaggugaucgucgacaucgacaaccgguccggguacagcggcaucuucagcguggaggggaaguccugcaucaaccgcugcuucuacguggagcugauccggggccgcgagcaggagacccgcgucugguggacgagcaacuccaucgugguguucugcggcaccagcgggaccuacggcaccggguccuggcccgacggcgccgacaucaaccugaugcccaucuga

SEQ ID NO: 75595 - RNA, 1410 nt, Artificial Sequence
  derived and/or modified sequence opt1 from neuraminidase__InfluenzaA__ABC40611
augaaccccaaccagaagaucaucaccaucggcagcaucucccugaccaucgccacgaucugcuuccucaugcagaucgccauccuggugaccaccgucacccugcacuucaagcaguacgagugcaacagccucccgaacaaccaggugaugcugugcgagcccacgaucaucgagcgcaacaucaccgagaucguguaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggucacccgggagcccuacguguccugcgaccccgacaagugcuaccaguucgcccugggccaggggaccacgcucaacaaccgccacagcaacgacaccgugcacgaccggacccccuaccgcacccugcugaugaacgagcucggcgucccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgugugcaucaacgggacgugcaccgucgugaugaccgacggcagcgccuccggccgggcggacaccaagauccuguucaucgaggaggggaagaucauccacaucagccagcucagcggcuccgcccagcacguggaggagugcagcugcuacccccgcuaccccgggguccggugcgugugccgcgacaacuggaagggcuccaaccggcccaucguggacaucaacgucaaggacuacagcaucguguccagcuacgugugcuccggccuggucggggacacgccgcgcaagaacgacagcuccagcuccagccacugccugaaccccaacaacgaggagggcgggcacggcgugaaggggugggccuucgacgacggcaacgacguguggaugggccggaccaucuccgagaaguuccgcagcggguacgagaccuucaaggucaucgagggcugguccaagcccaacagcaagcuccagaucaaccgccaggugaucgucgaccgggacaaccgguccggguacagcggcaucuucuccguggagggcaagagcugcaucaaccgcugcuucuacguggagcugauccgggggcgcaagcaggagaccgaggucugguggacgagcaacuccaucgugguguucugcggcaccagcgggaccuacggcaccggguccuggcccgacggcgccgacaucaaccugaugccgaucuga

SEQ ID NO: 75596 - RNA, 1410 nt, Artificial Sequence
  derived and/or modified sequence opt1 from neuraminidase__InfluenzaA__ABC40622
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcaacgccagcggccgggcggacaccaagauccucuucaucgaggagggcaagaucguccacaucagcccccuguccgggagcgcccagcacguggaggagugcuccugcuacccccgcuacccgggcgugcggugcaucugccgcgacaacuggaagggcagcaaccggcccgucguggacaucaacgugaaggacuacuccaucgacagcuccuacgucugcagcgggcuggugggcgacacgccccgcaacaacgaccgguccagcaacuccuacugccgcaaccccaacaacgagaaggggaaccacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgacaaccgcagcggcuacuccgggaucuucagcguggagggcaaguccugcaucaaccggugcuucuacgucgagcugauccgcggccgcgagcaggagacccgggugugguggacgagcaacagcaucguggucuucugcgggaccuccggcaccuacgggaccggcagcuggcccgacggggccgacaucaaccugaugcccaucuga

SEQ ID NO: 75597 - RNA, 1410 nt, Artificial Sequence
  derived and/or modified sequence opt1 from neuraminidase__InfluenzaA__ABC40634
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgucugcaucgacgggaccugcaccguggugaugaccgacggcagcgccuccgggaaggcggacacgaagauccuguucaucgaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaaccaggagaccgaggugcucuggaccagcaacuccaucgucguguucugcggcaccagcgggacguacggcaccggguccuggccggacggcgccgacaucaaccugaugcccaucuga

SEQ ID NO: 75598 - RNA, 1410 nt, Artificial Sequence
  derived and/or modified sequence opt1 from neuraminidase__InfluenzaA__ABC40645
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccgucgugagcugguccaagaagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaagcaggagaccgagguccuguggaccuccaacagcaucgugguguucugcggcaccuccgggacguacggcaccgggagcuggccggacggcgccgacaucaaccugaugcccaucuga

SEQ ID NO: 75599 - RNA, 1410 nt, Artificial Sequence
  derived and/or modified sequence opt1 from neuraminidase__InfluenzaA__ABC41706
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 75600 - RNA, 1413 nt, Artificial Sequence
  derived and/or modified sequence opt1 from neuraminidase__InfluenzaA__ABC41717
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccgucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 75601 - RNA, 1410 nt, Artificial Sequence
  derived and/or modified sequence opt1 from neuraminidase__InfluenzaA__ABC41728
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaacauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 75602 - RNA, 1410 nt, Artificial Sequence; identical to SEQ ID NO: 75599
  derived and/or modified sequence opt1 from neuraminidase__InfluenzaA__ABC41742

SEQ ID NO: 75603 - RNA, 1410 nt, Artificial Sequence; identical to SEQ ID NO: 75599
  derived and/or modified sequence opt1 from neuraminidase__InfluenzaA__ABC41956

SEQ ID NO: 75604 - RNA, 1410 nt, Artificial Sequence; identical to SEQ ID NO: 75599
  derived and/or modified sequence opt1 from neuraminidase__InfluenzaA__ABC41967

SEQ ID NO: 75605 - RNA, 1410 nt, Artificial Sequence; identical to SEQ ID NO: 75599
  derived and/or modified sequence opt1 from neuraminidase__InfluenzaA__ABC42017

SEQ ID NO: 75606 - RNA, 1410 nt, Artificial Sequence; identical to SEQ ID NO: 75599
  derived and/or modified sequence opt1 from neuraminidase__InfluenzaA__ABC42117

SEQ ID NO: 75607 - RNA, 1410 nt, Artificial Sequence; identical to SEQ ID NO: 75599
  derived and/or modified sequence opt1 from neuraminidase__InfluenzaA__ABC42128

SEQ ID NO: 75608 - RNA, 1410 nt, Artificial Sequence; identical to SEQ ID NO: 75599
  derived and/or modified sequence opt1 from neuraminidase__InfluenzaA__ABC42139

SEQ ID NO: 75609 - RNA, 1410 nt, Artificial Sequence
  derived and/or modified sequence opt1 from neuraminidase__InfluenzaA__ABC42150
augaaccccaaccagaagaucaucaccaucggcagcgugucccugaccaucgccacgaucugcuuccucaugcagaucgccauccuggcgaccaccgucacccugcacuucaagcagcacgagugcaacagcccgcccaacaaccaggugaugcucugcgagcccacgaucaucgagcgcaacaucaccgagaucguguaccugaccaacaccacgaucgagaaggagaucugccccaagcuggucgaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcggcaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggaccagcaacagcaucgucguguucugcgggaccuccggcaccuacgggacgggcagcuggccggacggcgccgacaucaaccugaugcccaucuga

SEQ ID NO: 75610 - RNA, 1410 nt, Artificial Sequence; identical to SEQ ID NO: 75599
  derived and/or modified sequence opt1 from neuraminidase__InfluenzaA__ABC42161

SEQ ID NO: 75611 - RNA, 1410 nt, Artificial Sequence
  derived and/or modified sequence opt1 from neuraminidase__InfluenzaA__ABC42172
augaaccccaaccagaagaucaucaccaucggcagcgugucccugaccaucgccacgaucugcagccucaugcagaucgccauccuggucaccaccgugacccugcacuucaagcagcacgagugcaacuccccgcccaacaaccaggugaugcucugcgagcccacgaucaucgagcgcaacaucaccgagaucgucuaccugaccaacaccacgaucgagaaggagaucugccccaagcugguggaguaccggaacuggagcaagccgcagugcaacaucaccggguucgcgcccuucuccaaggacaacagcauccgccucuccgccggcggggacaucugggugacccgggagcccuacgucagcugcgaccccgacaagugcuaccaguucgcccugggccaggggaccacgcugaacaacggccacuccaacgacaccgugcacgaccgcaccccguaccggacccuccugaugaacgagcugggcgugcccuuccaccucgggacgcgccaggucugcaucgccuggagcuccagcuccugccacgacggcaaggccuggcugcacgugugcgugaccggggacgacaagaacgcgaccgccagcuucaucuacaacggccggcuggucgacuccaucgggagcugguccaagaagauccuccgcacccaggagagcgagugcgugugcaucaacggcacgugcaccguggucaugaccgacggcuccgccagcgggaaggccgacaccaagauccuguucaucgaggagggcaagaucgugcacaucagcacgcuguccgggagcgcgcagcacguggaggagugcuccugcuacccccgguaccccggcguccgcugcgugugccgggacaacuggaagggcagcaaccgcccgaucguggacaucaacgucaaggacuacuccaucgugagcuccuacgugugcagcgggcucgucggcgacacgccccggaagaacgacuccuucagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggugaucgucgagcggggcaaccgcuccggguacagcggcaucuucuccguggagggcaagagcugcaucaaccggugcuucuacguggagcugauccgcgggcggaaggaggagaccgaggucugguggaccagcaacuccaucgugguguucugcggcaccagcgggaccuacggcacgggguccuggccggacggcgccgacaucaaccugaugcccaucuga

SEQ ID NO: 75612 - RNA, 1410 nt, Artificial Sequence; identical to SEQ ID NO: 75599
  derived and/or modified sequence opt1 from neuraminidase__InfluenzaA__ABC42183

SEQ ID NO: 75613 - RNA, 1410 nt, Artificial Sequence; identical to SEQ ID NO: 75599
  derived and/or modified sequence opt1 from neuraminidase__InfluenzaA__ABC42195

SEQ ID NO: 75614 - RNA, 1410 nt, Artificial Sequence; identical to SEQ ID NO: 75599
  derived and/or modified sequence opt1 from neuraminidase__InfluenzaA__ABC42310

SEQ ID NO: 75615 - RNA, 1410 nt, Artificial Sequence; identical to SEQ ID NO: 75599
  derived and/or modified sequence opt1 from neuraminidase__InfluenzaA__ABC42321

SEQ ID NO: 75616 - RNA, 1410 nt, Artificial Sequence; identical to SEQ ID NO: 75599
  derived and/or modified sequence opt1 from neuraminidase__InfluenzaA__ABC42349

SEQ ID NO: 75617 - RNA, 1410 nt, Artificial Sequence; identical to SEQ ID NO: 75599
  derived and/or modified sequence opt1 from neuraminidase__InfluenzaA__ABC42464

SEQ ID NO: 75618 - RNA, 1410 nt, Artificial Sequence; identical to SEQ ID NO: 75599
  derived and/or modified sequence opt1 from neuraminidase__InfluenzaA__ABC42497

SEQ ID NO: 75619 - RNA, 1410 nt, Artificial Sequence; identical to SEQ ID NO: 75599
  derived and/or modified sequence opt1 from neuraminidase__InfluenzaA__ABC42508

SEQ ID NO: 75620 - RNA, 1410 nt, Artificial Sequence; identical to SEQ ID NO: 75599
  derived and/or modified sequence opt1 from neuraminidase__InfluenzaA__ABC42519

SEQ ID NO: 75621 - RNA, 1410 nt, Artificial Sequence; identical to SEQ ID NO: 75599
  derived and/or modified sequence opt1 from neuraminidase__InfluenzaA__ABC42530

SEQ ID NO: 75622 - RNA, 1410 nt, Artificial Sequence; identical to SEQ ID NO: 75599
  derived and/or modified sequence opt1 from neuraminidase__InfluenzaA__ABC42577

SEQ ID NO: 75623 - RNA, 1410 nt, Artificial Sequence; identical to SEQ ID NO: 75599
  derived and/or modified sequence opt1 from neuraminidase__InfluenzaA__ABC42588

SEQ ID NO: 75624 - RNA, 1410 nt, Artificial Sequence; identical to SEQ ID NO: 75335
  derived and/or modified sequence opt1 from neuraminidase__InfluenzaA__ABC42599

SEQ ID NO: 75625 - RNA, 1410 nt, Artificial Sequence; identical to SEQ ID NO: 75335
  derived and/or modified sequence opt1 from neuraminidase__InfluenzaA__ABC42610

SEQ ID NO: 75626 - RNA, 1410 nt, Artificial Sequence; identical to SEQ ID NO: 75335
  derived and/or modified sequence opt1 from neuraminidase__InfluenzaA__ABC42621

SEQ ID NO: 75627 - RNA, 1410 nt, Artificial Sequence; identical to SEQ ID NO: 75335
  derived and/or modified sequence opt1 from neuraminidase__InfluenzaA__ABC42632

SEQ ID NO: 75628 - RNA, 1410 nt, Artificial Sequence; identical to SEQ ID NO: 75335
  derived and/or modified sequence opt1 from neuraminidase__InfluenzaA__ABC42643

SEQ ID NO: 75629 - RNA, 1410 nt, Artificial Sequence; identical to SEQ ID NO: 75335
  derived and/or modified sequence opt1 from neuraminidase__InfluenzaA__ABC42654

SEQ ID NO: 75630 - RNA, 1410 nt, Artificial Sequence; identical to SEQ ID NO: 75335
  derived and/or modified sequence opt1 from neuraminidase__InfluenzaA__ABC42665

SEQ ID NO: 75631 - RNA, 1410 nt, Artificial Sequence; identical to SEQ ID NO: 75335
  derived and/or modified sequence opt1 from neuraminidase__InfluenzaA__ABC42676

SEQ ID NO: 75632 - RNA, 1410 nt, Artificial Sequence; identical to SEQ ID NO: 75335
  derived and/or modified sequence opt1 from neuraminidase__InfluenzaA__ABC42687

SEQ ID NO: 75633 - RNA, 1410 nt, Artificial Sequence; identical to SEQ ID NO: 75335
  derived and/or modified sequence opt1 from neuraminidase__InfluenzaA__ABC42698

SEQ ID NO: 75634 - RNA, 1410 nt, Artificial Sequence; identical to SEQ ID NO: 75335
  derived and/or modified sequence opt1 from neuraminidase__InfluenzaA__ABC42709

SEQ ID NO: 75635 - RNA, 1410 nt, Artificial Sequence; identical to SEQ ID NO: 75335
  derived and/or modified sequence opt1 from neuraminidase__InfluenzaA__ABC42720

SEQ ID NO: 75636 - RNA, 1410 nt, Artificial Sequence
  derived and/or modified sequence opt1 from neuraminidase__InfluenzaA__ABC42742
augaaccccaaccagaagaucaucaccaucggcagcgugucccugaccaucagcacgaucugcuucuucaugcagaucgccauccucaugaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgccggaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 75637 - RNA, 1410 nt, Artificial Sequence; identical to SEQ ID NO: 75335
  derived and/or modified sequence opt1 from neuraminidase__InfluenzaA__ABC42764

SEQ ID NO: 75638 - RNA, 1410 nt, Artificial Sequence; identical to SEQ ID NO: 75335
  derived and/or modified sequence opt1 from neuraminidase__InfluenzaA__ABC42775

SEQ ID NO: 75639 - RNA, 1410 nt, Artificial Sequence; identical to SEQ ID NO: 75335
  derived and/or modified sequence opt1 from neuraminidase__InfluenzaA__ABC42786

SEQ ID NO: 75640 - RNA, 1410 nt, Artificial Sequence; identical to SEQ ID NO: 75335
  derived and/or modified sequence opt1 from neuraminidase__InfluenzaA__ABC42797

SEQ ID NO: 75641 - RNA, 1410 nt, Artificial Sequence; identical to SEQ ID NO: 75335
  derived and/or modified sequence opt1 from neuraminidase__InfluenzaA__ABC42808

SEQ ID NO: 75642 - RNA, 1410 nt, Artificial Sequence; identical to SEQ ID NO: 75335
  derived and/or modified sequence opt1 from neuraminidase__InfluenzaA__ABC42819

SEQ ID NO: 75643 - RNA, 1410 nt, Artificial Sequence
  derived and/or modified sequence opt1 from neuraminidase__InfluenzaA__ABC42841
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagccgcaaggccgacaccaagauccucuucaucgaggagggcaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggacuacuccaucgucagcuccuacgugugcagcgggcuggugggcgacacgccccggaagaacgacuccagcuccagcucccacugccucgaccccaacaacgaggagggcgggcacggcgucaaggggugggccuucgacgacggcaacgacguguggauggggcgcaccaucagcgagaagcugcgguccggcuacgagaccuucaaggucaucgagggcuggagcaaccccaacuccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 75644 - RNA, 1410 nt, Artificial Sequence; identical to SEQ ID NO: 75335
  derived and/or modified sequence opt1 from neuraminidase__InfluenzaA__ABC42852

SEQ ID NO: 75645 - RNA, 1410 nt, Artificial Sequence; identical to SEQ ID NO: 75335
  derived and/or modified sequence opt1 from neuraminidase__InfluenzaA__ABC42863

SEQ ID NO: 75646 - RNA, 1410 nt, Artificial Sequence; identical to SEQ ID NO: 75174
  derived and/or modified sequence opt1 from neuraminidase__InfluenzaA__ABC42874

SEQ ID NO: 75647 - RNA, 1410 nt, Artificial Sequence; identical to SEQ ID NO: 75174
  derived and/or modified sequence opt1 from neuraminidase__InfluenzaA__ABC42885

SEQ ID NO: 75648 - RNA, 1410 nt, Artificial Sequence; identical to SEQ ID NO: 75174
  derived and/or modified sequence opt1 from neuraminidase__InfluenzaA__ABC42896

SEQ ID NO: 75649 - RNA, 1410 nt, Artificial Sequence; identical to SEQ ID NO: 75599
  derived and/or modified sequence opt1 from neuraminidase__InfluenzaA__ABC42914

SEQ ID NO: 75650 - RNA, 1410 nt, Artificial Sequence; identical to SEQ ID NO: 75599
  derived and/or modified sequence opt1 from neuraminidase__InfluenzaA__ABC42932

SEQ ID NO: 75651 - RNA, 1410 nt, Artificial Sequence
  derived and/or modified sequence opt1 from neuraminidase__InfluenzaA__ABC42943
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggugggguaccggaacugguccaagccgcagugcaacaucaccggcuucgcgcccuucagcaaggacaacuccauccgccucagcgccgggggcgacaucugggugacccgggagcccuacgucuccugcgaccccgacaagugcuaccaguucgcccuggggcagggcaccacgcugaacaacggccacagcaacgacaccgugcacgaccgcaccccguaccggacccuccugaugaacgagcugggggugcccuuccaccucggcacgcgccaggucugcaucgccugguccagcuccagcugccacgacgggaaggccuggcugcacgugugcgugaccggcgacgacaagaacgcgaccgccuccuucaucuacaacgggcggcuggucgacagcaucggcuccuggagcaagaagauccuccgcacccaggaguccgagugcgugugcaucaacggcacgugcaccguggucaugaccgacgggagcgccuccggcaaggccgacaccaagauccuguucaucgaggaggggaagaucgugcacaucagcacgcugagcggcuccgcgcagcacguggaggagugcagcugcuacccccgguaccccggcguccgcugcgugugccgggacaacuggaagggguccaaccgcccgaucguggacaucaacgucaaggacuacagcaucguguccagcuacgugugcuccggccucgucggggacacgccccggaagaacgacagcuucuccagcucccacugccuggaccccaacaacgaggagggcgggcacggcgugaagggcugggccuucgacgacgggaacgacgucuggaugggccgcaccaucagcgagaagcugcgguccggguacgagaccuucaaggugaucgagggcuggagcaagcccaacuccaagcuccagaucaaccgccaggugaucgucgagcgggggaaccgcagcggcuacuccggcaucuucagcguggaggggaaguccugcaucaaccggugcuucuacguggagcugauccgcggccggaaggaggagaccgaggucugguggaccagcaacagcaucgugguguucugcgggaccuccggcaccuacgggacgggcagcuggccggacggcgccgacaucaaccugaugcccaucuga

SEQ ID NO: 75652 - RNA, 1410 nt, Artificial Sequence; identical to SEQ ID NO: 75599
  derived and/or modified sequence opt1 from neuraminidase__InfluenzaA__ABC42954

SEQ ID NO: 75653 - RNA, 1410 nt, Artificial Sequence; identical to SEQ ID NO: 75599
  derived and/or modified sequence opt1 from neuraminidase__InfluenzaA__ABC42965

SEQ ID NO: 75654 - RNA, 1410 nt, Artificial Sequence
  derived and/or modified sequence opt1 from neuraminidase__InfluenzaA__ABC42976
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggcgaugcucugcgagcccacgaucaucgagcgcaacaucaccgagaucguguaccugaccaacaccacgaucgagaaggagaucugccccaagcuggucgaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75655 - RNA, 1410 nt, Artificial Sequence; identical to SEQ ID NO: 75599
  derived and/or modified sequence opt1 from neuraminidase__InfluenzaA__ABC42987

SEQ ID NO: 75656 - RNA, 1410 nt, Artificial Sequence; identical to SEQ ID NO: 75599
  derived and/or modified sequence opt1 from neuraminidase__InfluenzaA__ABC42998

SEQ ID NO: 75657 - RNA, 1410 nt, Artificial Sequence; identical to SEQ ID NO: 75599
  derived and/or modified sequence opt1 from neuraminidase__InfluenzaA__ABC43009

SEQ ID NO: 75658 - RNA, 1410 nt, Artificial Sequence; identical to SEQ ID NO: 75599
  derived and/or modified sequence opt1 from neuraminidase__InfluenzaA__ABC43020

SEQ ID NO: 75659 - RNA, 1410 nt, Artificial Sequence
  derived and/or modified sequence opt1 from neuraminidase__InfluenzaA__ABC43042
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugauguccaucuga

SEQ ID NO: 75660 - RNA, 1410 nt, Artificial Sequence; identical to SEQ ID NO: 75599
  derived and/or modified sequence opt1 from neuraminidase__InfluenzaA__ABC43053

SEQ ID NO: 75661 - RNA, 1410 nt, Artificial Sequence
  derived and/or modified sequence opt1 from neuraminidase__InfluenzaA__ABC43064
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggagaagaccgaggucugguggaccagcaacagcaucgugguguucugcggcaccuccgggaccuacggcacggggagcuggccggacggcgccgacaucaaccugaugcccaucuga

SEQ ID NO: 75662 - RNA, 1410 nt, Artificial Sequence; identical to SEQ ID NO: 75599
  derived and/or modified sequence opt1 from neuraminidase__InfluenzaA__ABC43075

SEQ ID NO: 75663 - RNA, 1410 nt, Artificial Sequence
  derived and/or modified sequence opt1 from neuraminidase__InfluenzaA__ABC43086
augaaccccaaccagaagaucaucaccaucggcagcgugucccugaucaucgccaccaucugcuuccucaugcagaucgccauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcugguggaguaccggaacugguccaagccgcagugcaacaucacgggguucgcgcccuucagcaaggacaacuccauccgccucagcgccggcggggacaucugggugacccgggagcccuacgucuccugcgaccccgacaagugcuaccaguucgcccugggccaggggaccacccugaacaacggccacagcaacgacacggugcacgaccgcaccccguaccggacccuccugaugaacgagcugggcgugcccuuccaccucgggacccgccaggucugcaucgccugguccagcuccagcugccacgacggcaaggccuggcugcacgugugcgugacgggggacgacaagaacgcgaccgccuccuucaucuacaacggccggcuggucgacagcaucggguccuggagcaagaagauccuccgcacccaggaguccgagugcgugugcaucaacgggaccugcacgguggucaugaccgacggcagcgccuccgggaaggccgacaccaagauccuguucaucgaggagggcaagaucgugcacaucagcacccugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggacgagcaacagcaucgugguguucugcggcaccuccgggaccuacggcaccgggagcuggccggacggcgccgacaucaaccugaugcccaucuga

SEQ ID NO: 75664 - RNA, 1410 nt, Artificial Sequence; identical to SEQ ID NO: 75599
  derived and/or modified sequence opt1 from neuraminidase__InfluenzaA__ABC43097

SEQ ID NO: 75665 - RNA, 1410 nt, Artificial Sequence; identical to SEQ ID NO: 75599
  derived and/or modified sequence opt1 from neuraminidase__InfluenzaA__ABC43108

SEQ ID NO: 75666 - RNA, 1410 nt, Artificial Sequence; identical to SEQ ID NO: 75599
  derived and/or modified sequence opt1 from neuraminidase__InfluenzaA__ABC43119

SEQ ID NO: 75667 - RNA, 1410 nt, Artificial Sequence; identical to SEQ ID NO: 75335
  derived and/or modified sequence opt1 from neuraminidase__InfluenzaA__ABC43130

SEQ ID NO: 75668 - RNA, 1410 nt, Artificial Sequence; identical to SEQ ID NO: 75335
  derived and/or modified sequence opt1 from neuraminidase__InfluenzaA__ABC43141

SEQ ID NO: 75669 - RNA, 1410 nt, Artificial Sequence; identical to SEQ ID NO: 75335
  derived and/or modified sequence opt1 from neuraminidase__InfluenzaA__ABC43152

SEQ ID NO: 75670 - RNA, 1410 nt, Artificial Sequence; identical to SEQ ID NO: 75335
  derived and/or modified sequence opt1 from neuraminidase__InfluenzaA__ABC43163

SEQ ID NO: 75671 - RNA, 1410 nt, Artificial Sequence; identical to SEQ ID NO: 75335
  derived and/or modified sequence opt1 from neuraminidase__InfluenzaA__ABC43174

SEQ ID NO: 75672 - RNA, 1410 nt, Artificial Sequence
  derived and/or modified sequence opt1 from neuraminidase__InfluenzaA__ABC43185
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacacccgcauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 75673 - RNA, 1410 nt, Artificial Sequence; identical to SEQ ID NO: 75335
  derived and/or modified sequence opt1 from neuraminidase__InfluenzaA__ABC43478

SEQ ID NO: 75674 - RNA, 1410 nt, Artificial Sequence; identical to SEQ ID NO: 75335
  derived and/or modified sequence opt1 from neuraminidase__InfluenzaA__ABC43489

SEQ ID NO: 75675 - RNA, 1410 nt, Artificial Sequence; identical to SEQ ID NO: 75335
  derived and/or modified sequence opt1 from neuraminidase__InfluenzaA__ABC43500

SEQ ID NO: 75676 - RNA, 1410 nt, Artificial Sequence
  derived and/or modified sequence opt1 from neuraminidase__InfluenzaA__ABC43511
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagacgaccaucaucgagcgcaacaucaccgagaucguguaccucaccaacacgaccaucgagaaggagaucugccccaagcuggccgaguaccggaacuggagcaagccccagugcgacaucaccggguucgcgccguucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcacccccuaccggacgcugcucaugaacgagcugggcgugccguuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcagcggccuggugggcgacaccccgcgcaagaacgacuccagcuccagcucccacugccucgaccccaacaacgaggagggcggccacggggucaagggcugggccuucgacgacgggaacgacguguggaugggccggacgaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggcccgacggcgccgacaucaaccugaugccgaucuga

SEQ ID NO: 75677 - RNA, 1410 nt, Artificial Sequence; identical to SEQ ID NO: 75335
  derived and/or modified sequence opt1 from neuraminidase__InfluenzaA__ABC43522

SEQ ID NO: 75678 - RNA, 1410 nt, Artificial Sequence; identical to SEQ ID NO: 75335
  derived and/or modified sequence opt1 from neuraminidase__InfluenzaA__ABC43533

SEQ ID NO: 75679 - RNA, 1410 nt, Artificial Sequence; identical to SEQ ID NO: 75335
  derived and/or modified sequence opt1 from neuraminidase__InfluenzaA__ABC43544

SEQ ID NO: 75680 - RNA, 1410 nt, Artificial Sequence; identical to SEQ ID NO: 75335
  derived and/or modified sequence opt1 from neuraminidase__InfluenzaA__ABC43555

SEQ ID NO: 75681 - RNA, 1410 nt, Artificial Sequence; identical to SEQ ID NO: 75578
  derived and/or modified sequence opt1 from neuraminidase__InfluenzaA__ABC46557

SEQ ID NO: 75682 - RNA, 1410 nt, Artificial Sequence
  derived and/or modified sequence opt1 from neuraminidase__InfluenzaA__ABC46579
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacggggcacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagcuccagaucaaccgccaggugaucgucgacagcgacaaccgguccggguacagcggcaucuucagcguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 75683 - RNA, 1410 nt, Artificial Sequence; identical to SEQ ID NO: 75522
  derived and/or modified sequence opt1 from neuraminidase__InfluenzaA__ABC50170

SEQ ID NO: 75684 - RNA, 1410 nt, Artificial Sequence; identical to SEQ ID NO: 75522
  derived and/or modified sequence opt1 from neuraminidase__InfluenzaA__ABC50181

SEQ ID NO: 75685 - RNA, 1410 nt, Artificial Sequence; identical to SEQ ID NO: 75522
  derived and/or modified sequence opt1 from neuraminidase__InfluenzaA__ABC50192

SEQ ID NO: 75686 - RNA, 1410 nt, Artificial Sequence; identical to SEQ ID NO: 75174
  derived and/or modified sequence opt1 from neuraminidase__InfluenzaA__ABC50203

SEQ ID NO: 75687 - RNA, 1410 nt, Artificial Sequence
  derived and/or modified sequence opt1 from neuraminidase__InfluenzaA__ABC50214
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucaucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacccgaagcuccagaccaaccgccaggucaucguggagcggggcaaccgcuccggguacagcggcaucuucuccguggagggcaagagcugcaucaaccggugcuucuacgucgagcugauccgcgggcggaaggaggagaccgaggugugguggaccuccaacagcaucguggucuucugcggcaccagcgggacguacggcaccggguccuggcccgacggcgccgacaucaaccugaugcccaucuga

SEQ ID NO: 75688 - RNA, 1410 nt, Artificial Sequence; identical to SEQ ID NO: 75174
  derived and/or modified sequence opt1 from neuraminidase__InfluenzaA__ABC50225

SEQ ID NO: 75689 - RNA, 1410 nt, Artificial Sequence; identical to SEQ ID NO: 75174
  derived and/or modified sequence opt1 from neuraminidase__InfluenzaA__ABC50247

SEQ ID NO: 75690 - RNA, 1410 nt, Artificial Sequence
  derived and/or modified sequence opt1 from neuraminidase__InfluenzaA__ABC50258
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucaucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaccaaccgccaggucaucguggagcggggcaaccgcagcggguacuccggcaucuucagcaucgagggcaaguccugcaucaaccggugcuucuacguggagcugauccgcgggcggaaggaggagaccgaggucugguggaccagcaacagcaucgugguguucugcggcaccuccgggacguacggcaccgggagcuggccggacggcgccgacaucaaccugaugcccaucuga

SEQ ID NO: 75691 - RNA, 1410 nt, Artificial Sequence; identical to SEQ ID NO: 75174
  derived and/or modified sequence opt1 from neuraminidase__InfluenzaA__ABC50280

SEQ ID NO: 75692 - RNA, 1410 nt, Artificial Sequence; identical to SEQ ID NO: 75174
  derived and/or modified sequence opt1 from neuraminidase__InfluenzaA__ABC50291

SEQ ID NO: 75693 - RNA, 1410 nt, Artificial Sequence
  derived and/or modified sequence opt1 from neuraminidase__InfluenzaA__ABC50302
augaaccccaaccagaagaucaucaccaucggcagcgugucccugaccaucgccacgaucugcuuccucaugcagaucgccauccugaucaccaccgucacccugcacuucaagcaguacgagugcaacagcccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgccugguccagcuccagcugccacgacggcaaggcguggcugcacgugugcgucaccggggacgacgagaacgccaccgccuccuucaucuacaacggccggcugguggacagcaucggguccuggagcaagaagauccuccgcacccaggaguccgagugcgugugcaucaacggcacgugcaccgucgugaugaccgacggcagcgccuccgggaaggcggacaccaagauccuguucaucgaggagggcaagaucgugcacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaccaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggacguacggcaccgggagcuggccggacggcgccgacaucaaccugaugcccaucuga

SEQ ID NO: 75694 - RNA, 1410 nt, Artificial Sequence
  derived and/or modified sequence opt1 from neuraminidase__InfluenzaA__ABC50313
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 75695 - RNA, 1410 nt, Artificial Sequence; identical to SEQ ID NO: 75174
  derived and/or modified sequence opt1 from neuraminidase__InfluenzaA__ABC50324

SEQ ID NO: 75696 - RNA, 1410 nt, Artificial Sequence; identical to SEQ ID NO: 75162
  derived and/or modified sequence opt1 from neuraminidase__InfluenzaA__ABC50335

SEQ ID NO: 75697 - RNA, 1410 nt, Artificial Sequence
  derived and/or modified sequence opt1 from neuraminidase__InfluenzaA__ABC50346
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucaucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaccaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggacguacggcaccgggagcuggccggacggcgccgacaucaaccugaugcccaucuga

SEQ ID NO: 75698 - RNA, 1410 nt, Artificial Sequence; identical to SEQ ID NO: 75174
  derived and/or modified sequence opt1 from neuraminidase__InfluenzaA__ABC50357

SEQ ID NO: 75699 - RNA, 1410 nt, Artificial Sequence; identical to SEQ ID NO: 75174
  derived and/or modified sequence opt1 from neuraminidase__InfluenzaA__ABC50368

SEQ ID NO: 75700 - RNA, 1410 nt, Artificial Sequence; identical to SEQ ID NO: 75174
  derived and/or modified sequence opt1 from neuraminidase__InfluenzaA__ABC50379

SEQ ID NO: 75701 - RNA, 1410 nt, Artificial Sequence; identical to SEQ ID NO: 75174
  derived and/or modified sequence opt1 from neuraminidase__InfluenzaA__ABC50390

SEQ ID NO: 75702 - RNA, 1410 nt, Artificial Sequence
  derived and/or modified sequence opt1 from neuraminidase__InfluenzaA__ABC50412
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 75703 - RNA, 1410 nt, Artificial Sequence; identical to SEQ ID NO: 75702
  derived and/or modified sequence opt1 from neuraminidase__InfluenzaA__ABC50423

SEQ ID NO: 75704 - RNA, 1410 nt, Artificial Sequence; identical to SEQ ID NO: 75287
  derived and/or modified sequence opt1 from neuraminidase__InfluenzaA__ABC54671

SEQ ID NO: 75705 - RNA, 1410 nt, Artificial Sequence; identical to SEQ ID NO: 75419
  derived and/or modified sequence opt1 from neuraminidase__InfluenzaA__ABC54682

SEQ ID NO: 75706 - RNA, 1410 nt, Artificial Sequence; identical to SEQ ID NO: 75599
  derived and/or modified sequence opt1 from neuraminidase__InfluenzaA__ABC67322

SEQ ID NO: 75707 - RNA, 1410 nt, Artificial Sequence; identical to SEQ ID NO: 75174
  derived and/or modified sequence opt1 from neuraminidase__InfluenzaA__ABC67474

SEQ ID NO: 75708 - RNA, 1410 nt, Artificial Sequence; identical to SEQ ID NO: 75697
  derived and/or modified sequence opt1 from neuraminidase__InfluenzaA__ABC67546

SEQ ID NO: 75709 - RNA, 1410 nt, Artificial Sequence
  derived and/or modified sequence opt1 from neuraminidase__InfluenzaA__ABC67557
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaagaagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 75710 - RNA, 1410 nt, Artificial Sequence
  derived and/or modified sequence opt1 from neuraminidase__InfluenzaA__ABC67568
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggacgagcaacuccaucguggucuucugcgggaccagcggcaccuacgggaccggcuccuggcccgacggggccaacaucaaccugaugcccaucuga

SEQ ID NO: 75711 - RNA, 1410 nt, Artificial Sequence
  derived and/or modified sequence opt1 from neuraminidase__InfluenzaA__ABC67579
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagccggcggaguaccggaacugguccaagccccagugcaagaucaccggguucgcccccuucagcaaggacaacuccauccgccugagcgccggcggggacaucugggugacccgggagcccuacguguccugcgacccggacaagugcuaccaguucgcccucggccaggggaccacgcugaacaacggccacagcaacgacaccguccacgaccgcacccccuaccggacccugcucaugaacgagcugggcgugcccuuccaccuggggacgaagcaggucugcaucgccugguccagcuccagcugccacgacggcaaggcguggcuccacgugugcgugaccgggcacgacgagaacgccaccgccuccuucaucuacgacggccgccugguggacagcaucggguccuggagcaagaagauccugcggacccaggaguccgagugcgucugcaucaacggcacgugcaccguggugaugaccgacggcagcgccuccgggcgcgcggacaccaagauccucuucaucgaggagggcaagaucguccacaucagccagcugagcggguccgcccagcacguggaggagugcagcugcuacccccgguacccgggcgugcgcugcgucugccgggacaacuggaagggcuccaaccgccccaucguggacaucaacgugaaggaccacagcaucgucuccagcuacgugugcuccgggcuggugggcgacacgccccggaagaacgacagcuccagcuccagccacugccucaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacagcaagcugcagaucaaccgccaggugaucguggaccggggcaaccgcuccggguacagcggcaucuucuccgucgagggcaagagcugcaucaaccggugcuucuacguggagcucauccgcgggcggaagcaggagaccgaggugugguggacgagcaacuccaucgucguguucugcggcaccagcgggaccuacggcaccggguccuggcccgacggcgccgacaucaaccugaugcccaucuga

SEQ ID NO: 75712 - RNA, 1410 nt, Artificial Sequence; identical to SEQ ID NO: 75335
  derived and/or modified sequence opt1 from neuraminidase__InfluenzaA__ABC67590

SEQ ID NO: 75713 - RNA, 1410 nt, Artificial Sequence; identical to SEQ ID NO: 75335
  derived and/or modified sequence opt1 from neuraminidase__InfluenzaA__ABC67601

SEQ ID NO: 75714 - RNA, 1410 nt, Artificial Sequence; identical to SEQ ID NO: 75174
  derived and/or modified sequence opt1 from neuraminidase__InfluenzaA__ABC67612

SEQ ID NO: 75715 - RNA, 1410 nt, Artificial Sequence; identical to SEQ ID NO: 75174
  derived and/or modified sequence opt1 from neuraminidase__InfluenzaA__ABC67623

SEQ ID NO: 75716 - RNA, 1410 nt, Artificial Sequence
  derived and/or modified sequence opt1 from neuraminidase__InfluenzaA__ABC67634
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggagcuccagcuccugccacgacggcaaggcguggcugcacgucugcgugaccggggacgacgagaacgccaccgccagcuucaucuacaacggccggcugguggacuccaucgggagcugguccaagaagauccuccgcacccaggagagcgagugcgucugcaucaacggcacgugcaccguggugaugaccgacggcuccgccagcgggaaggcggacaccaagauccuguucaucgaggagggcaagaucguccacaucuccacgcugagcgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacagcaagcuccagaccaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcaccagcgggacguacggcaccggguccuggcccgacggcgccgacaucaaccugaugcccaucuga

SEQ ID NO: 75717 - RNA, 1410 nt, Artificial Sequence; identical to SEQ ID NO: 75174
  derived and/or modified sequence opt1 from neuraminidase__InfluenzaA__ABC67645

SEQ ID NO: 75718 - RNA, 1410 nt, Artificial Sequence; identical to SEQ ID NO: 75174
  derived and/or modified sequence opt1 from neuraminidase__InfluenzaA__ABC67656

SEQ ID NO: 75719 - RNA, 1410 nt, Artificial Sequence
  derived and/or modified sequence opt1 from neuraminidase__InfluenzaA__ABC67700
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacuccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggcccgacggcgccgacaucaaccugaugccgaucuga

SEQ ID NO: 75720 - RNA, 1410 nt, Artificial Sequence
  derived and/or modified sequence opt1 from neuraminidase__InfluenzaA__ABC67711
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 75721 - RNA, 1410 nt, Artificial Sequence
  derived and/or modified sequence opt1 from neuraminidase__InfluenzaA__ABC67736
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcguggccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 75722 - RNA, 1410 nt, Artificial Sequence
  derived and/or modified sequence opt1 from neuraminidase__InfluenzaA__ABC67809
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 75723 - RNA, 1410 nt, Artificial Sequence; identical to SEQ ID NO: 75599
  derived and/or modified sequence opt1 from neuraminidase__InfluenzaA__ABC67820

SEQ ID NO: 75724 - RNA, 1410 nt, Artificial Sequence; identical to SEQ ID NO: 75578
  derived and/or modified sequence opt1 from neuraminidase__InfluenzaA__ABC67842

SEQ ID NO: 75725 - RNA, 1410 nt, Artificial Sequence; identical to SEQ ID NO: 75174
  derived and/or modified sequence opt1 from neuraminidase__InfluenzaA__ABC67853

SEQ ID NO: 75726 - RNA, 1410 nt, Artificial Sequence; identical to SEQ ID NO: 75578
  derived and/or modified sequence opt1 from neuraminidase__InfluenzaA__ABC67864

SEQ ID NO: 75727 - RNA, 1410 nt, Artificial Sequence; identical to SEQ ID NO: 75697
  derived and/or modified sequence opt1 from neuraminidase__InfluenzaA__ABC67886

SEQ ID NO: 75728 - RNA, 1410 nt, Artificial Sequence; identical to SEQ ID NO: 75174
  derived and/or modified sequence opt1 from neuraminidase__InfluenzaA__ABC67897

SEQ ID NO: 75729 - RNA, 1410 nt, Artificial Sequence; identical to SEQ ID NO: 75174
  derived and/or modified sequence opt1 from neuraminidase__InfluenzaA__ABC67970

SEQ ID NO: 75730 - RNA, 1410 nt, Artificial Sequence
  derived and/or modified sequence opt1 from neuraminidase__InfluenzaA__ABC67981
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccaguaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggacguacggcaccgggagcuggccggacggcgccgacaucaaccugaugcccaucuga

SEQ ID NO: 75731 - RNA, 1410 nt, Artificial Sequence
  derived and/or modified sequence opt1 from neuraminidase__InfluenzaA__ABC67992
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacaacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaucgaggugugguggaccagcaacagcaucgucguguucugcggcaccuccgggaccuacggcacggggagcuggccggacggcgccgacaucaaccugaugcccaucuga

SEQ ID NO: 75732 - RNA, 1410 nt, Artificial Sequence; identical to SEQ ID NO: 75697
  derived and/or modified sequence opt1 from neuraminidase__InfluenzaA__ABC68003

SEQ ID NO: 75733 - RNA, 1410 nt, Artificial Sequence
  derived and/or modified sequence opt1 from neuraminidase__InfluenzaA__ABC68052
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaucgacggcagcgccuccgggaaggcggacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagacggaggugugguggaccagcaacagcaucgucguguucugcggcaccuccgggaccuacggcacggggagcuggccggacggcgccgacaucaaccugaugcccaucuga

SEQ ID NO: 75734 - RNA, 1410 nt, Artificial Sequence; identical to SEQ ID NO: 75174
  derived and/or modified sequence opt1 from neuraminidase__InfluenzaA__ABC68063

SEQ ID NO: 75735 - RNA, 1410 nt, Artificial Sequence; identical to SEQ ID NO: 75174
  derived and/or modified sequence opt1 from neuraminidase__InfluenzaA__ABC68074

SEQ ID NO: 75736 - RNA, 1410 nt, Artificial Sequence; identical to SEQ ID NO: 75720
  derived and/or modified sequence opt1 from neuraminidase__InfluenzaA__ABC68085

SEQ ID NO: 75737 - RNA, 1410 nt, Artificial Sequence
  derived and/or modified sequence opt1 from neuraminidase__InfluenzaA__ABC68096
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccacaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75738 - RNA, 1410 nt, Artificial Sequence
  derived and/or modified sequence opt1 from neuraminidase__InfluenzaA__ABC68225
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 75739 - RNA, 1410 nt, Artificial Sequence; identical to SEQ ID NO: 75527
  derived and/or modified sequence opt1 from neuraminidase__InfluenzaA__ABC68236

SEQ ID NO: 75740 - RNA, 1350 nt, Artificial Sequence
  derived and/or modified sequence opt1 from neuraminidase__InfluenzaA__ABC72646
augaaccccaacaagaagaucaucaccaucggcagcaucugcauggugaccgggauggucucccugaugcuccagaucggcaaccugaucagcaucugggugucccacagcauccacacggggaaccagcagaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcaggggagccugcugaacgacaagcacuccaacggcaccgugaaggaccggagcccccaccgcacccucauguccugcccggugggggaggcccccagccccuacaacucccgguucgagagcgucgccuggagcgcguccgccugccacgacggcaccagcuggcugacgaucgggaucuccggccccgacagcggcgccguggccgugcugaaguacaacgggaucaucaccgacaccaucaaguccuggcgcaacaacauccuccggacccaggagagcgagugcgcgugcgucaacggcuccugcuucacggugaugaccgacgggccgagcaacggccaggccucccacaagaucuucaagauggacaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaccccgcgccccaacgacggcaccggcuccugcgggcccgugagcuccaacggcaccuacggggucaagggcuucagcuucaaguacgggaacggcguguggaucggccggaccaaguccaccaacagccgcagcggguucgagaugaucugggaccccaacggcuggacggagaccgacuccagcuucuccgugaagcaggacaucgucgccaucaccgacuggagcggguacuccggcagcuucgugcagcacccggagcucaccgggcuggacugcauccggcccugcuucugggucgagcugauccgcggccggcccaaggaguccacgaucuggaccagcggcuccagcaucuccuucugcggggugaacagcgacaccgugggcugguccuggcccgacggggcggagcucccguucaccaucgacaaguga

SEQ ID NO: 75741 - RNA, 1410 nt, Artificial Sequence; identical to SEQ ID NO: 75103
  derived and/or modified sequence opt1 from neuraminidase__InfluenzaA__ABC84392

SEQ ID NO: 75742 - RNA, 1410 nt, Artificial Sequence; identical to SEQ ID NO: 75517
  derived and/or modified sequence opt1 from neuraminidase__InfluenzaA__ABC84403

SEQ ID NO: 75743 - RNA, 1410 nt, Artificial Sequence; identical to SEQ ID NO: 75522
  derived and/or modified sequence opt1 from neuraminidase__InfluenzaA__ABC84414

SEQ ID NO: 75744 - RNA, 1410 nt, Artificial Sequence
  derived and/or modified sequence opt1 from neuraminidase__InfluenzaA__ABC84425
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgaggggaagaacugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 75745 - RNA, 1410 nt, Artificial Sequence; identical to SEQ ID NO: 75335
  derived and/or modified sequence opt1 from neuraminidase__InfluenzaA__ABC84436

SEQ ID NO: 75746 - RNA, 1410 nt, Artificial Sequence
  derived and/or modified sequence opt1 from neuraminidase__InfluenzaA__ABC84447
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 75747 - RNA, 1410 nt, Artificial Sequence; identical to SEQ ID NO: 75722
  derived and/or modified sequence opt1 from neuraminidase__InfluenzaA__ABC84501

SEQ ID NO: 75748 - RNA, 1410 nt, Artificial Sequence; identical to SEQ ID NO: 75722
  derived and/or modified sequence opt1 from neuraminidase__InfluenzaA__ABC84512

SEQ ID NO: 75749 - RNA, 1410 nt, Artificial Sequence
  derived and/or modified sequence opt1 from neuraminidase__InfluenzaA__ABC84523
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggccgacuccaucgugagcugguccaaggagauccugcggacccaggagagcgagugcgucugcaucaacggcacgugcaccguggugaugaccgacggguccgccagcggcaaggcggacaccaagauccucuucaucgaggagggcaagaucguccacacgagcacccuguccgggagcgcccagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 75750 - RNA, 1410 nt, Artificial Sequence
  derived and/or modified sequence opt1 from neuraminidase__InfluenzaA__ABC84545
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggcagcgcggacaccaagauccucuucaucgaggagggcaagaucguccacaucagcccccuguccgggagcgcccagcacguggaggagugcuccugcuacccccgguacccgggcgugcgcugcaucugccgggacaacuggaagggcagcaaccgccccgucguggacaucaacgugaaggaccacuccaucgacagcuccuacgucugcagcgggcuggugggcgacacgccccggaacaacgaccgcuccagcaacuccuacugccggaaccccaacaacgagaaggggaaccacggcgugaaggggugggccuucgacgacggcaacgacgucuggaugggccgcaccaucagcgaggacucccggagcggguacgagaccuucaaggugaucggcgggugguccaccccgaacagcaagcuccagaucaaccgccaggucaucguggacuccgacaaccggagcggcuacuccgggaucuucagcguggagggcaagagcugcaucaaccgcugcuucuacgucgagcugauccggggccgcgagcaggagacccgcgugugguggacguccaacagcaucguggucuucugcgggaccuccggcaccuacgggaccggcagcuggcccgacggggccgacaucaaccugaugcccaucuga

SEQ ID NO: 75751 - RNA, 1410 nt, Artificial Sequence; identical to SEQ ID NO: 75738
  derived and/or modified sequence opt1 from neuraminidase__InfluenzaA__ABC84574

SEQ ID NO: 75752 - RNA, 1410 nt, Artificial Sequence; identical to SEQ ID NO: 75738
  derived and/or modified sequence opt1 from neuraminidase__InfluenzaA__ABC85757

SEQ ID NO: 75753 - RNA, 1410 nt, Artificial Sequence; identical to SEQ ID NO: 75749
  derived and/or modified sequence opt1 from neuraminidase__InfluenzaA__ABC85768

SEQ ID NO: 75754 - RNA, 1410 nt, Artificial Sequence; identical to SEQ ID NO: 75738
  derived and/or modified sequence opt1 from neuraminidase__InfluenzaA__ABC85779

SEQ ID NO: 75755 - RNA, 1410 nt, Artificial Sequence; identical to SEQ ID NO: 75738
  derived and/or modified sequence opt1 from neuraminidase__InfluenzaA__ABC85790

SEQ ID NO: 75756 - RNA, 1410 nt, Artificial Sequence; identical to SEQ ID NO: 75722
  derived and/or modified sequence opt1 from neuraminidase__InfluenzaA__ABC85801

SEQ ID NO: 75757 - RNA, 1410 nt, Artificial Sequence; identical to SEQ ID NO: 75722
  derived and/or modified sequence opt1 from neuraminidase__InfluenzaA__ABC85812

SEQ ID NO: 75758 - RNA, 1410 nt, Artificial Sequence; identical to SEQ ID NO: 75749
  derived and/or modified sequence opt1 from neuraminidase__InfluenzaA__ABC85823

SEQ ID NO: 75759 - RNA, 1410 nt, Artificial Sequence; identical to SEQ ID NO: 75721
  derived and/or modified sequence opt1 from neuraminidase__InfluenzaA__ABC85834

SEQ ID NO: 75760 - RNA, 1410 nt, Artificial Sequence; identical to SEQ ID NO: 75722
  derived and/or modified sequence opt1 from neuraminidase__InfluenzaA__ABC85845

SEQ ID NO: 75761 - RNA, 1410 nt, Artificial Sequence; identical to SEQ ID NO: 75749
  derived and/or modified sequence opt1 from neuraminidase__InfluenzaA__ABC85856

SEQ ID NO: 75762 - RNA, 1410 nt, Artificial Sequence; identical to SEQ ID NO: 75721
  derived and/or modified sequence opt1 from neuraminidase__InfluenzaA__ABC85867

SEQ ID NO: 75763 - RNA, 1410 nt, Artificial Sequence; identical to SEQ ID NO: 75720
  derived and/or modified sequence opt1 from neuraminidase__InfluenzaA__ABC85900

SEQ ID NO: 75764 - RNA, 1410 nt, Artificial Sequence
  derived and/or modified sequence opt1 from neuraminidase__InfluenzaA__ABC85911
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacauguggauggggcgcaccaucagcgagaagcugcgguccggcuacgagaccuucaaggugaucgagggguggagcaagcccaacuccaagcuccagaccaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggacguacggcaccgggagcuggccggacggcgccgacaucaaccugaugcccaucuga

SEQ ID NO: 75765 - RNA, 1410 nt, Artificial Sequence
  derived and/or modified sequence opt1 from neuraminidase__InfluenzaA__ABC85922
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaccaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgacagcgacaagugcuaccaguucgcccugggccaggggacgacccugaacaacggccacuccaacgacaccguccacgaccgcacccccuaccggacgcuccugaugaacgagcugggcgugccguuccaccucgggacccgccaggugugcaucgccuggagcuccagcuccugccacgacggcaaggcguggcugcacgucugcgugaccggggacgacgagaacgccaccgccagcuucaucuacaacggccggcugguggacuccaucgggagcugguccaagaagauccuccgcacgcaggagagcgagugcgucugcaucaacgggaccugcaccguggugaugaccgacggcuccgccagcgggaaggcggacacgaagauccuguucaucgaggagggcaagaucguccacaucagcacccuguccgggagcgcccagcacguggaggagugcuccugcuacccccgguaccccggcgugcgcugcgucugccgggacaacuggaagggcagcaaccgccccaucguggacaucaacgugaaggacuacuccaucgucagcuccuacgugugcagcgggcucgugggcgacaccccgcggaagaacgacuccuucagcuccagccacugccuggaccccaacaacgaggagggcggccacggggucaagggcugggccuucgacgacggcaacgacguguggauggggcgcaccaucuccgagaagcugcggagcggcuacgagacguucaaggucaucgaggggugguccaagcccaacagcaagcuccagaccaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcacgagcgggaccuacggcaccggguccuggcccgacggcgccgacaucaaccugaugccgaucuga

SEQ ID NO: 75766 - RNA, 1410 nt, Artificial Sequence; identical to SEQ ID NO: 75174
  derived and/or modified sequence opt1 from neuraminidase__InfluenzaA__ABC85933

SEQ ID NO: 75767 - RNA, 1410 nt, Artificial Sequence
  derived and/or modified sequence opt1 from neuraminidase__InfluenzaA__ABC85955
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccgcaugcccaucuga

SEQ ID NO: 75768 - RNA, 1410 nt, Artificial Sequence; identical to SEQ ID NO: 75174
  derived and/or modified sequence opt1 from neuraminidase__InfluenzaA__ABC85966

SEQ ID NO: 75769 - RNA, 1410 nt, Artificial Sequence; identical to SEQ ID NO: 75174
  derived and/or modified sequence opt1 from neuraminidase__InfluenzaA__ABC85977

SEQ ID NO: 75770 - RNA, 1410 nt, Artificial Sequence
  derived and/or modified sequence opt1 from neuraminidase__InfluenzaA__ABC85988
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggggaucugccccaagcuggcggaguaccggaacugguccaagccgcagugcaacaucaccggcuucgcccccuucagcaaggacaacuccauccgccucagcgccgggggcgacaucugggugacccgggagcccuacguguccugcgaccccgacaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccagcuccagcugccacgacgggaaggcguggcugcacgucugcgugaccggcgacgacgagaacgccaccgccuccuucaucuacaacgggcggcugguggacagcaucggcuccuggagcaagaagauccuccgcacccaggaguccgagugcgucugcaucaacggcacgugcaccguggugaugaccgacgggagcgccuccggcaaggcggacaccaagauccuguucaucgaggaggggaagaucguccacaucagcacgcugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaccaaccgccaggugaucguggagcgggggaaccgcagcggcuacuccggcaucuucagcgucgaggggaaguccugcaucaaccggugcuucuacguggagcugauccgcggccggaaggaggagaccgaggugugguggaccagcaacagcaucgucguguucugcgggaccuccggcacguacgggaccggcagcuggccggacggcgccgacaucaaccugaugcccaucuga

SEQ ID NO: 75771 - RNA, 1410 nt, Artificial Sequence; identical to SEQ ID NO: 75335
  derived and/or modified sequence opt1 from neuraminidase__InfluenzaA__ABC85999

SEQ ID NO: 75772 - RNA, 1410 nt, Artificial Sequence; identical to SEQ ID NO: 75335
  derived and/or modified sequence opt1 from neuraminidase__InfluenzaA__ABC86010

SEQ ID NO: 75773 - RNA, 1410 nt, Artificial Sequence
  derived and/or modified sequence opt1 from neuraminidase__InfluenzaA__ABC86021
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccaacaucaaccugaugcccaucuga

SEQ ID NO: 75774 - RNA, 1410 nt, Artificial Sequence; identical to SEQ ID NO: 75599
  derived and/or modified sequence opt1 from neuraminidase__InfluenzaA__ABC86127

SEQ ID NO: 75775 - RNA, 1410 nt, Artificial Sequence; identical to SEQ ID NO: 75682
  derived and/or modified sequence opt1 from neuraminidase__InfluenzaA__ABC86140

SEQ ID NO: 75776 - RNA, 1410 nt, Artificial Sequence; identical to SEQ ID NO: 75492
  derived and/or modified sequence opt1 from neuraminidase__InfluenzaA__ABC86151

SEQ ID NO: 75777 - RNA, 1413 nt, Artificial Sequence
  derived and/or modified sequence opt1 from neuraminidase__InfluenzaA__ABC86240
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagaagaucaucaccuacgagaaccgcaccugggucaaccagaccuacgugaacaucaacaacacgaacguggucgcggggaaggacaagaccuccaugacccuggccggcaacagcucccugugcccgauccggggcugggccaucuacaccaaggacaacagcauccgcaucggguccaagggcgacguguucgugauccgggagcccuucaucagcugcucccaccucgagugccgcacguucuuccugacccagggggcccugcucaacgacaagcacagcaacggcaccaucaaggaccggucccccuuccgcgcccugaugagcugcccccugggggaggcgccgucccccuacaacagccgguucgaguccgucgccuggagcgccagcgccugccacgacggccucggcuggcugaccaucgggaucuccggccccgacaacggggcgguggccgugcugaaguacaacggcaucaucacggagaccaucaagagcuggaagaagcagauccuccgcacccaggaguccgagugcgucugcgugaacggcagcugcuucaccaucaugacggacgggcccuccaaccgggccgccagcuaccgcaucuucaagaucgagaagggccgggugaccaaguccaucgagcuggacgccccgaacuaccacuacgaggagugcagcugcuaccccgacaccgggaccgucaugugcgugugccgcgacaacuggcacggcuccaaccggcccugggugagcuucaaccagaaccuggacuaccagaucggguacaucugcuccggcgucuucggcgacaacccccgcccgaaggacggggagggcagcugcaaccccgugacgguggacggggcggacggcgucaagggguucuccuaccgguacggcaacggcguguggaucgggcgcaccaagagcaaccggcuccgcaagggcuucgagaugaucugggaccccaacggguggaccgacaccgacuccgacuucagcaugaagcaggacguggucgccaugacggacugguccggcuacagcggguccuucgugcagcaccccgagcugaccggccuggacugcaugcggccgugcuucuggguggagcucguccgcggccugccccgggagaacaccaccaucuggacgagcgggagcuccaucagcuucugcggcgugaacuccgagaccgccaacuggagcuggcccgacggggccgagcugcccuucaccaucgacaaguga

SEQ ID NO: 75778 - RNA, 1410 nt, Artificial Sequence
  derived and/or modified sequence opt1 from neuraminidase__InfluenzaA__ABC97377
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggcagcgcggacaccaagauccucuucaucgaggagggcaagaucguccacaucagcccccuguccgggagcgcccagcacguggaggagugcuccugcuacccccgguacccgggcgugcgcugcaucugccgggacaacuggaagggcagcaaccgccccgucguggacaucaacgugaaggacuacuccaucgacagcuccuacgucugcagcgggcuggugggcgacacgccccggaacaacgaccgcuccagcaacuccuacugccggaaccccaacaacgagaaggggaaccacggcgugaaggggugggccuucgacgacggcaacgacgucuggaugggccgcaccaucagcgaggacucccggagcggguacgagaccuucaaggugaucggcgggugguccaccccgaacagcaagcuccagaucaaccgccaggucaucguggacuccgacaaccggagcggcuacuccgggaucuucagcguggagggcaagagcugcaucaaccgcugcuucuacgucgagcugauccggggccgcgagcaggagacccgcgugugguggacguccaacagcaucguggucuucugcgggaccuccggcaccuacgggaccggcagcuggcccgacggggccgacaucaaccugaugcccaucuga

SEQ ID NO: 75779 - RNA, 1410 nt, Artificial Sequence; identical to SEQ ID NO: 75145
  derived and/or modified sequence opt1 from neuraminidase__InfluenzaA__ABD15452

SEQ ID NO: 75780 - RNA, 1410 nt, Artificial Sequence; identical to SEQ ID NO: 75233
  derived and/or modified sequence opt1 from neuraminidase__InfluenzaA__ABD15463

SEQ ID NO: 75781 - RNA, 1410 nt, Artificial Sequence; identical to SEQ ID NO: 75153
  derived and/or modified sequence opt1 from neuraminidase__InfluenzaA__ABD15474

SEQ ID NO: 75782 - RNA, 1410 nt, Artificial Sequence
  derived and/or modified sequence opt1 from neuraminidase__InfluenzaA__ABD15485
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccaacaucaaccugaugcccaucuga

SEQ ID NO: 75783 - RNA, 1410 nt, Artificial Sequence; identical to SEQ ID NO: 75233
  derived and/or modified sequence opt1 from neuraminidase__InfluenzaA__ABD15496

SEQ ID NO: 75784 - RNA, 1410 nt, Artificial Sequence; identical to SEQ ID NO: 75153
  derived and/or modified sequence opt1 from neuraminidase__InfluenzaA__ABD15507

SEQ ID NO: 75785 - RNA, 1413 nt, Artificial Sequence
  derived and/or modified sequence opt1 from neuraminidase__InfluenzaA__ABD15518
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcggggccuccuacaagaucuucaagaucgagaagggcaaggucaccaagagcaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggcuacaucugcagcgggguguucggcgacaacccccgccccaaggacgggaagggcuccugcaacccggugacggucgacggggccgacggcgugaagggcuucagcuacaaguacgggaacggcguguggaucgggcggaccaaguccaaccgccugcggaagggcuucgagaugaucugggaccccaacggguggaccgacaccgacagcgacuucuccgucaagcaggacgugguggcgaucacggacuggagcggcuacagcggcuccuucguccagcaccccgagcucaccgggcuggacugcauccgccccugcuucuggguggagcugguccggggccucccgcgcgagaacaccaccaucuggacgagcggguccagcaucuccuucugcggcguggacagcgacaccgccaacugguccuggcccgacggcgccgagcugcccuucaccaucgacaaguga

SEQ ID NO: 75786 - RNA, 1410 nt, Artificial Sequence; identical to SEQ ID NO: 75335
  derived and/or modified sequence opt1 from neuraminidase__InfluenzaA__ABD15529

SEQ ID NO: 75787 - RNA, 1410 nt, Artificial Sequence; identical to SEQ ID NO: 75522
  derived and/or modified sequence opt1 from neuraminidase__InfluenzaA__ABD15551

SEQ ID NO: 75788 - RNA, 1410 nt, Artificial Sequence
  derived and/or modified sequence opt1 from neuraminidase__InfluenzaA__ABD15562
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccaucgugaugaccgacggcuccgccagcggccgggcggacaccaagauccuguucaucgaggaggggaagaucgugcacaucagcccccuguccggcagcgcccagcacgucgaggagugcuccugcuacccccgcuacccgggggugcggugcgugugccgcgacaacuggaagggcagcaaccggcccaucgucgacaucaacgugaaggacuacuccaucgugagcuccuacgucugcagcggccucgugggggacacgccccgcaagaacgacuccagcuccagcucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggagcaagccgaacuccaagcugcagaucaaccggcaggucaucguggaccgcgggaaccggagcggcuacuccgggaucuucagcguggagggcaagagcugcaucaaccgcugcuucuacgucgagcucauccggggccgcaagcaggagaccgaggugugguggacguccaacagcaucguggucuucugcgggaccuccggcaccuacgggaccggcagcuggcccgacggggccgacaucaaccugaugcccaucuga

SEQ ID NO: 75789 - RNA, 1410 nt, Artificial Sequence
  derived and/or modified sequence opt1 from neuraminidase__InfluenzaA__ABD15573
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcauggccugguccagcuccagcugccacgacggcaaggcguggcugcacgugugcgugaccgggcacgacgagaacgccaccgccuccuucaucuacgacggccgccugguggacagcaucggguccuggagcaagaagauccuccggacccaggaguccgagugcgucugcaucaacggcacgugcaccguggugaugaccgacggcagcgccuccgggcgcgcggacaccaagauccuguucaucgaggagggcaagaucguccacaucagccagcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuccagcuccagccacugccugaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggaccggggcaaccgcuccggguacagcggcaucuucuccgucgagggcaagagcugcaucaaccggugcuucuacguggagcugauccgcgggcggaagcaggagaccgaggugugguggacgagcaacuccaucgucguguucugcggcaccagcgggaccuacggcaccggguccuggccggacggcgccgacaucaaccugaugcccaucuga

SEQ ID NO: 75790 - RNA, 1410 nt, Artificial Sequence
  derived and/or modified sequence opt1 from neuraminidase__InfluenzaA__ABD15584
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacgagaacgacguguggaugggccggaccaucagcgagaaguuccgcuccggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugugguggacguccaacagcaucaucgucuucugcggcaccuccgggaccuacggcaccgggagcuggcccgacggcgccgacaucaaccugaugcccaucuga

SEQ ID NO: 75791 - RNA, 1410 nt, Artificial Sequence; identical to SEQ ID NO: 75522
  derived and/or modified sequence opt1 from neuraminidase__InfluenzaA__ABD15595

SEQ ID NO: 75792 - RNA, 1410 nt, Artificial Sequence; identical to SEQ ID NO: 75522
  derived and/or modified sequence opt1 from neuraminidase__InfluenzaA__ABD15606

SEQ ID NO: 75793 - RNA, 1410 nt, Artificial Sequence; identical to SEQ ID NO: 75522
  derived and/or modified sequence opt1 from neuraminidase__InfluenzaA__ABD15617

SEQ ID NO: 75794 - RNA, 1410 nt, Artificial Sequence; identical to SEQ ID NO: 75581
  derived and/or modified sequence opt1 from neuraminidase__InfluenzaA__ABD15639

SEQ ID NO: 75795 - RNA, 1410 nt, Artificial Sequence; identical to SEQ ID NO: 75738
  derived and/or modified sequence opt1 from neuraminidase__InfluenzaA__ABD15650

SEQ ID NO: 75796 - RNA, 1410 nt, Artificial Sequence; identical to SEQ ID NO: 75261
  derived and/or modified sequence opt1 from neuraminidase__InfluenzaA__ABD15661

SEQ ID NO: 75797 - RNA, 1410 nt, Artificial Sequence; identical to SEQ ID NO: 75738
  derived and/or modified sequence opt1 from neuraminidase__InfluenzaA__ABD15683

SEQ ID NO: 75798 - RNA, 1410 nt, Artificial Sequence; identical to SEQ ID NO: 75261
  derived and/or modified sequence opt1 from neuraminidase__InfluenzaA__ABD15694

SEQ ID NO: 75799 - RNA, 1410 nt, Artificial Sequence; identical to SEQ ID NO: 75738
  derived and/or modified sequence opt1 from neuraminidase__InfluenzaA__ABD15705

SEQ ID NO: 75800 - RNA, 1410 nt, Artificial Sequence; identical to SEQ ID NO: 75738
  derived and/or modified sequence opt1 from neuraminidase__InfluenzaA__ABD15727

SEQ ID NO: 75801 - RNA, 1410 nt, Artificial Sequence
  derived and/or modified sequence opt1 from neuraminidase__InfluenzaA__ABD15749
augaaccccaaccagaagaucaucaccaucggcagcgugucccugaccaucgccacgaucugcuuccucaugcagaucgccguccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggcggacaccaagauccuguucaucgaggagggcaagaucgugcacacgagccugcucagcggguccgcccagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcuggucggcgacacgccccgcaagaacgacagcuccagcuccagccacugccuggaccccaacaacgaggagggcgggcacggggugaagggcugggccuucgacgacggcaacgacgucuggauggggcggaccaucuccgagaagcuccgcagcggcuacgagaccuucaaggugaucgaggggugguccaagcccaacagcaagcugcagaucaaccgccaggugaucgucgaccggggcaaccgguccggguacagcggcaucuucuccguggagggcaagagcugcaucaaccgcugcuucuacguggagcugauccgggggcgcaagcaggagaccgagguccucuggaccagcaacuccaucgugguguucugcggcaccagcgggaccuacggcacgggguccuggccggacggcgccgacaucaaccugaugcccaucuga

SEQ ID NO: 75802 - RNA, 1410 nt, Artificial Sequence; identical to SEQ ID NO: 75801
  derived and/or modified sequence opt1 from neuraminidase__InfluenzaA__ABD15760

SEQ ID NO: 75803 - RNA, 1410 nt, Artificial Sequence; identical to SEQ ID NO: 75738
  derived and/or modified sequence opt1 from neuraminidase__InfluenzaA__ABD15771

SEQ ID NO: 75804 - RNA, 1410 nt, Artificial Sequence; identical to SEQ ID NO: 75738
  derived and/or modified sequence opt1 from neuraminidase__InfluenzaA__ABD15782

SEQ ID NO: 75805 - RNA, 1410 nt, Artificial Sequence; identical to SEQ ID NO: 75738
  derived and/or modified sequence opt1 from neuraminidase__InfluenzaA__ABD15793

SEQ ID NO: 75806 - RNA, 1410 nt, Artificial Sequence; identical to SEQ ID NO: 75722
  derived and/or modified sequence opt1 from neuraminidase__InfluenzaA__ABD16306

SEQ ID NO: 75807 - RNA, 1410 nt, Artificial Sequence
  derived and/or modified sequence opt1 from neuraminidase__InfluenzaA__ABD16317
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 75808 - RNA, 1410 nt, Artificial Sequence; identical to SEQ ID NO: 75722
  derived and/or modified sequence opt1 from neuraminidase__InfluenzaA__ABD16328

SEQ ID NO: 75809 - RNA, 1410 nt, Artificial Sequence
  derived and/or modified sequence opt1 from neuraminidase__InfluenzaA__ABD16339
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 75810 - RNA, 1410 nt, Artificial Sequence
  derived and/or modified sequence opt1 from neuraminidase__InfluenzaA__ABD16361
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggaagcugguggacuccaucgucagcugguccaagaagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 75811 - RNA, 1410 nt, Artificial Sequence; identical to SEQ ID NO: 75722
  derived and/or modified sequence opt1 from neuraminidase__InfluenzaA__ABD16475

SEQ ID NO: 75812 - RNA, 1410 nt, Artificial Sequence; identical to SEQ ID NO: 75722
  derived and/or modified sequence opt1 from neuraminidase__InfluenzaA__ABD16486

SEQ ID NO: 75813 - RNA, 1410 nt, Artificial Sequence; identical to SEQ ID NO: 75749
  derived and/or modified sequence opt1 from neuraminidase__InfluenzaA__ABD16497

SEQ ID NO: 75814 - RNA, 1410 nt, Artificial Sequence; identical to SEQ ID NO: 75722
  derived and/or modified sequence opt1 from neuraminidase__InfluenzaA__ABD16508

SEQ ID NO: 75815 - RNA, 1410 nt, Artificial Sequence
  derived and/or modified sequence opt1 from neuraminidase__InfluenzaA__ABD16519
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggacauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaccgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 75816 - RNA, 1410 nt, Artificial Sequence
  derived and/or modified sequence opt1 from neuraminidase__InfluenzaA__ABD16530
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaagcggugcaucaaccgcugcuucuacguggagcugauccgggggcgcaaggaggagaccgaggucugguggaccuccaacagcaucgugguguucugcggcaccagcgggaccuacggcacgggguccuggccggacggcgccgacaucaaccugaugcccaucuga

SEQ ID NO: 75817 - RNA, 1410 nt, Artificial Sequence; identical to SEQ ID NO: 75599
  derived and/or modified sequence opt1 from neuraminidase__InfluenzaA__ABD16541

SEQ ID NO: 75818 - RNA, 1410 nt, Artificial Sequence; identical to SEQ ID NO: 75722
  derived and/or modified sequence opt1 from neuraminidase__InfluenzaA__ABD16552

SEQ ID NO: 75819 - RNA, 1410 nt, Artificial Sequence; identical to SEQ ID NO: 75721
  derived and/or modified sequence opt1 from neuraminidase__InfluenzaA__ABD16563

SEQ ID NO: 75820 - RNA, 1410 nt, Artificial Sequence
  derived and/or modified sequence opt1 from neuraminidase__InfluenzaA__ABD16574
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccggugcuucuacguggagcugauccgcgggcgcaagaaggagacgcgggucugguggaccuccaacagcaucgugguguucugcggcaccuccgggaccuacggcacggggagcuggcccgacggcgccgacaucaaccucaugcccaucuga

SEQ ID NO: 75821 - RNA, 1410 nt, Artificial Sequence
  derived and/or modified sequence opt1 from neuraminidase__InfluenzaA__ABD16585
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccggugcuucuacguggagcugauccgcgggcgcgagcaggagacgcgggucugguggaccuccaacagcaucgugguguucugcggcaccuccgggaccuacggcacggggagcuggcccgacggcgccgacaucaaccucaugcccaucuga

SEQ ID NO: 75822 - RNA, 1410 nt, Artificial Sequence
  derived and/or modified sequence opt1 from neuraminidase__InfluenzaA__ABD16721
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacgaagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcuacugccagaacccgaacaacgagaagggcaaccacggggucaagggcugggccuucgacgacgggaacgacguguggaugggccggaccaucggcgaggagcuccgcuccggguacgagaccuucaaggucaucggcggguggagcacccccaacuccaagcugcagaucaaccgccaggugaucguggacagcaagaaccgguccggcuacagcgggaucuucuccgucgagggcaagagcugcaucaaccggugcuucuacguggagcugauccgcggccgggagcaggagacccgcgugugguggacgagcaacuccaucgucguguucugcgggaccagcggcaccuacgggaccggcuccuggcccgacggggccgacaucaaccucaugcccaucuga

SEQ ID NO: 75823 - RNA, 1410 nt, Artificial Sequence; identical to SEQ ID NO: 75492
  derived and/or modified sequence opt1 from neuraminidase__InfluenzaA__ABD16732

SEQ ID NO: 75824 - RNA, 1410 nt, Artificial Sequence
  derived and/or modified sequence opt1 from neuraminidase__InfluenzaA__ABD16743
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggacccacggcgugaaggggugggccuucgacgacggcaacgacgucuggaugggccggaccaucagcgaggacucccgcagcggguacgagaccuucaaggugaucggcgggugguccacgccgaacagcaagcuccagaugaaccggcaggucaucguggacuccgacaaccgcagcggcuacuccgggaucuucagcguggagggcaagagcugcaucaaccggugcuucuacgucgagcugauccgcggccgcgagcaggagacccgggugugguggaccuccaacagcaucguggucuucugcgggaccuccggcacguacgggaccggcagcuggcccgacggggccgacaucaaccugaugcccaucuga

SEQ ID NO: 75825 - RNA, 1410 nt, Artificial Sequence; identical to SEQ ID NO: 75584
  derived and/or modified sequence opt1 from neuraminidase__InfluenzaA__ABD16754

SEQ ID NO: 75826 - RNA, 1410 nt, Artificial Sequence; identical to SEQ ID NO: 75682
  derived and/or modified sequence opt1 from neuraminidase__InfluenzaA__ABD16765

SEQ ID NO: 75827 - RNA, 1410 nt, Artificial Sequence; identical to SEQ ID NO: 75126
  derived and/or modified sequence opt1 from neuraminidase__InfluenzaA__ABD17326

SEQ ID NO: 75828 - RNA, 1410 nt, Artificial Sequence
  derived and/or modified sequence opt1 from neuraminidase__InfluenzaA__ABD38137
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucaucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaccaaccgccaggucaucguggagcggggcaaccgcagcggguacuccggcaucuucagcguggagggcaaguccugcaucaaccggugcuucuacgucgagcugauccgcgggcggaaggaggagccggaggugugguggaccagcaacagcaucguggucuucugcggcacccccgggaccuacggcacgggguccuggcccgacggcgccgacaucaaccugaugcccaucuga

SEQ ID NO: 75829 - RNA, 1413 nt, Artificial Sequence; identical to SEQ ID NO: 75394
  derived and/or modified sequence opt1 from neuraminidase__InfluenzaA__ABD60782

SEQ ID NO: 75830 - RNA, 1410 nt, Artificial Sequence
  derived and/or modified sequence opt1 from neuraminidase__InfluenzaA__ABD60793
augaaccccaaccagaagaucaucaccaucggcagcgugucccugaccaucgccacgaucugcuuccucaugcagaucgccauccuggucaccaccgugacccugcacuucaagcaguacgagugcgacagcccggugaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcgcccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggucugcaucgccugguccagcuccagcugccacgacggcaaggccuggcuccacgugugcgugacgggguacgacaagaacgcgaccgccuccuucaucuacgacggccggcuggucgacagcaucguguccuggagccagaacauccugcgcacccaggaguccgagugcgugugcaucaacgggaccugcacggucgugaugaccgacggcagcgccuccgagcgggccgacaccaagauccucuucaucgaggagggcaagaucgugcacaucagcccccugagcggguccgcgcagcacgucgaggagugcagcugcuacccccgcuacccgggcgugcggugcaucugccgcgacaacuggaagggguccaaccggcccguggucgacaucaacgugaaggacuacagcaucgacuccagcuacgugugcuccggccuggucggcgacacgccccgcaacaacgaccggagcuccaacagcuacugccgcaaccccaacaacgagaaggggaaccacggcgugaaggggugggccuucgacgacggcaacgaccucuggauggggcggaccaucuccgaggacagccgcuccggcuacgagaccuucaaggucaucggcggguggagcaccccgaacuccaagcugcagaucaaccgccaggugaucguggacagcgacaaccgguccggcuacagcgggaucuucuccgucgagggcaagagcugcaucaaccggugcuucuacguggagcugauccgcgggcgcgagcaggagacccgggugugguggacgagcaacuccaucaucgucuucugcggcaccagcggcaccuacgggaccggcuccuggcccgacggggccgacaucaaccucaugcccaucuga

SEQ ID NO: 75831 - RNA, 1410 nt, Artificial Sequence; identical to SEQ ID NO: 75527
  derived and/or modified sequence opt1 from neuraminidase__InfluenzaA__ABD60804

SEQ ID NO: 75832 - RNA, 1410 nt, Artificial Sequence; identical to SEQ ID NO: 75720
  derived and/or modified sequence opt1 from neuraminidase__InfluenzaA__ABD60815

SEQ ID NO: 75833 - RNA, 1410 nt, Artificial Sequence; identical to SEQ ID NO: 75722
  derived and/or modified sequence opt1 from neuraminidase__InfluenzaA__ABD60826

SEQ ID NO: 75834 - RNA, 1410 nt, Artificial Sequence; identical to SEQ ID NO: 75801
  derived and/or modified sequence opt1 from neuraminidase__InfluenzaA__ABD60837

SEQ ID NO: 75835 - RNA, 1410 nt, Artificial Sequence
  derived and/or modified sequence opt1 from neuraminidase__InfluenzaA__ABD60848
augaaccccaaccagaagaucaucaccaucggcagcgugucccugaccaucgccacgaucugcuuccucaugcaggucgccauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggcggacaccaagauccuguucaucgaggagggcaagaucgugcacacgagccugcucagcggguccgcccagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcuggucggcgacacgccccgcaagaacgacagcuccagcuccagccacugccuggaccccaacaacgaggagggcgggcacggggugaagggcugggccuucgacgacggcaacgacgucuggauggggcggaccaucuccgagaagcuccgcagcggcuacgagaccuucaaggugaucgaggggugguccaagcccaacagcaagcugcagaucaaccgccaggugaucgucgaccggggcaaccgguccggguacagcggcaucuucuccguggagggcaagagcugcaucaaccgcugcuucuacguggagcugauccgggggcgcaagcaggagaccgagguccucuggaccagcaacuccaucgugguguucugcggcaccagcgggaccuacggcacgggguccuggccggacggcgccgacaucaaccugaugcccaucuga

SEQ ID NO: 75836 - RNA, 1413 nt, Artificial Sequence
  derived and/or modified sequence opt1 from neuraminidase__InfluenzaA__ABD60881
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75837 - RNA, 1413 nt, Artificial Sequence
  derived and/or modified sequence opt1 from neuraminidase__InfluenzaA__ABD60892
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcgugaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcaacuucuccgugaagcaggacguggucgccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75838 - RNA, 1413 nt, Artificial Sequence; identical to SEQ ID NO: 75836
  derived and/or modified sequence opt1 from neuraminidase__InfluenzaA__ABD60903

SEQ ID NO: 75839 - RNA, 1413 nt, Artificial Sequence; identical to SEQ ID NO: 75423
  derived and/or modified sequence opt1 from neuraminidase__InfluenzaA__ABD60914

SEQ ID NO: 75840 - RNA, 1410 nt, Artificial Sequence
  derived and/or modified sequence opt1 from neuraminidase__InfluenzaA__ABD60925
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacaucaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggaccuacggcacggggagcuggccggacggcgccgacaucaaccugaugcccaucuga

SEQ ID NO: 75841 - RNA, 1413 nt, Artificial Sequence
  derived and/or modified sequence opt1 from neuraminidase__InfluenzaA__ABD60947
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccaucaaggaccggucccccuaccgcgcccugaugagcugccccaucggggaggccccgucccccuacaacagccgguucgagagcgucgcgugguccgccagcgccugccacgacggcaugggcuggcugaccaucgggaucuccggccccgacgacggggccguggcggugcucaaguacaacggcaucaucacggagaccaucaagagcuggcgcaagcagauccugcggacccaggaguccgagugcgucugcgugaacggcagcugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgugaugugcgucugccgggacaacuggcacgggagcaaccgccccuggguguccuucaaccagaaccucgacuaccagaucggcuacaucugcagcggcguguucggggacaacccgcggcccaaggacggcaagggguccugcgaccccgucaacguggacggcgccgacggggugaagggcuucagcuaccgcuacggcaacggggucuggaucggccggacgaaguccaacagcucccgcaagggguucgagaugaucugggaccccaacggcuggaccgacaccgacagcaacuuccuggugaagcaggacguggucgccaugaccgacuggagcggguacuccggcagcuucgugcagcacccggagcugacgggccucgacugcaugcggcccugcuucuggguggagcugauccgcgggcggccccgcgagaagaccaccaucuggaccuccggcagcuccaucagcuucugcggggucaacuccgacacggugaacuggagcuggcccgacggcgcggagcugccguucaccaucgacaaguga

SEQ ID NO: 75842 - RNA, 1410 nt, Artificial Sequence
  derived and/or modified sequence opt1 from neuraminidase__InfluenzaA__ABD61263
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacgggaugaagggcugggccuucgacgacggcaacgacgucuggauggggcgcaccaucagcgagaagcugcgguccggcuacgagaccuucaaggugaucgagggguggagcaagcccaacuccaagcuccaggucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75843 - RNA, 1410 nt, Artificial Sequence; identical to SEQ ID NO: 75153
  derived and/or modified sequence opt1 from neuraminidase__InfluenzaA__ABD61274

SEQ ID NO: 75844 - RNA, 1410 nt, Artificial Sequence
  derived and/or modified sequence opt1 from neuraminidase__InfluenzaA__ABD61285
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacgggaacgccuccggcaaggccgacaccaagauccucuucaucgaggagggcaagaucgugcacacgagcacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 75845 - RNA, 1410 nt, Artificial Sequence; identical to SEQ ID NO: 75599
  derived and/or modified sequence opt1 from neuraminidase__InfluenzaA__ABD61296

SEQ ID NO: 75846 - RNA, 1410 nt, Artificial Sequence; identical to SEQ ID NO: 75720
  derived and/or modified sequence opt1 from neuraminidase__InfluenzaA__ABD61307

SEQ ID NO: 75847 - RNA, 1410 nt, Artificial Sequence; identical to SEQ ID NO: 75738
  derived and/or modified sequence opt1 from neuraminidase__InfluenzaA__ABD61318

SEQ ID NO: 75848 - RNA, 1410 nt, Artificial Sequence; identical to SEQ ID NO: 75069
  derived and/or modified sequence opt1 from neuraminidase__InfluenzaA__ABD61340

SEQ ID NO: 75849 - RNA, 1410 nt, Artificial Sequence; identical to SEQ ID NO: 75069
  derived and/or modified sequence opt1 from neuraminidase__InfluenzaA__ABD61351

SEQ ID NO: 75850 - RNA, 1410 nt, Artificial Sequence
  derived and/or modified sequence opt1 from neuraminidase__InfluenzaA__ABD61362
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggaggugugccccaagcuggcggaguaccggaacugguccaagccgcagugcaacaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggcggacaccaagauccuguucaucgaggagggcaagaucgugcacacgagcagccuguccgggagcgcccagcacguggaggagugcuccugcuacccccgcuaccccggcguccggugcgugugccgcgacaacuggaagggcagcaaccggccgaucguggacaucaacgucaaggacuacuccaucgugagcuccuacgugugcagcgggcucgucggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccgccaggugaucgucgaccggggcaaccggagcggguacuccggcaucuucagcguggagggcaagagcugcaucaaccgcugcuucuacguggagcugauccgggggcgcaagcaggagaccgagguccuguggaccuccaacagcaucgugguguucugcggcaccuccgggaccuacggcacggggagcuggccggacggcgccgacaucgaccucaugcccaucuga

SEQ ID NO: 75851 - RNA, 1410 nt, Artificial Sequence; identical to SEQ ID NO: 75801
  derived and/or modified sequence opt1 from neuraminidase__InfluenzaA__ABD61373

SEQ ID NO: 75852 - RNA, 1410 nt, Artificial Sequence
  derived and/or modified sequence opt1 from neuraminidase__InfluenzaA__ABD61384
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcucgugggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccggcaggucaucguggaccgcggcaaccggagcggguacuccggcaucuucagcguggagagcaaguccugcaucaaccgcugcuucuacgucgagcugauccggggccgcaagcaggagaccgaggugcuguggaccagcaacuccaucguggucuucugcgggaccagcggcaccuacgggacgggcuccuggccggacggggccgacaucaaccucaugcccaucuga

SEQ ID NO: 75853 - RNA, 1410 nt, Artificial Sequence; identical to SEQ ID NO: 75738
  derived and/or modified sequence opt1 from neuraminidase__InfluenzaA__ABD61395

SEQ ID NO: 75854 - RNA, 1410 nt, Artificial Sequence; identical to SEQ ID NO: 75835
  derived and/or modified sequence opt1 from neuraminidase__InfluenzaA__ABD61406

SEQ ID NO: 75855 - RNA, 1413 nt, Artificial Sequence; identical to SEQ ID NO: 75836
  derived and/or modified sequence opt1 from neuraminidase__InfluenzaA__ABD61521

SEQ ID NO: 75856 - RNA, 1410 nt, Artificial Sequence
  derived and/or modified sequence opt1 from neuraminidase__InfluenzaA__ABD61532
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggagcacccccaacuccaagcugcagaucaaccgccaggugaucguggacagcgagaaccgguccggcuacagcgggaucuucuccgucgagggcaagagcugcaucaaccgcugcuucuacguggagcugauccggggccgcgagcaggagacccgcgugugguggacgagcaacuccaucgucguguucugcgggaccagcggcaccuacgggaccggcuccuggcccgacggggccgacaucagccucaugcccaucuga

SEQ ID NO: 75857 - RNA, 1413 nt, Artificial Sequence
  derived and/or modified sequence opt1 from neuraminidase__InfluenzaA__ABD61543
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggagcggguacagcggcaacuucguccagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 75858 - RNA, 1413 nt, Artificial Sequence; identical to SEQ ID NO: 75836
  derived and/or modified sequence opt1 from neuraminidase__InfluenzaA__ABD63066

SEQ ID NO: 75859 - RNA, 1410 nt, Artificial Sequence; identical to SEQ ID NO: 75261
  derived and/or modified sequence opt1 from neuraminidase__InfluenzaA__ABD77601

SEQ ID NO: 75860 - RNA, 1410 nt, Artificial Sequence
  derived and/or modified sequence opt1 from neuraminidase__InfluenzaA__ABD77612
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaugugccccaagcuggcggaguaccggaacuggcucaagccgcagugcaacaucaccggguucgcccccuucuccaaggacaacagcauccgccuguccgccggcggggacaucugggugacccgggagcccuacgugagcugcgaccccgacaagugcuaccaguucgcccugggccaggggaccacgcucaacaacggccacuccaacgacaccguccacgaccgcaccccguaccggacccugcugaugaacgagcucggcgugcccuuccaccuggggacgaagcaggucugcaucgccuggagcuccagcuccugccacgacggcaaggcguggcugcacgugugcgugaccggggacgacgagaacgccaccgccagcaucaucuacaacggccgccucguggacuccaucgggagcugguccaagaagauccugcggacccaggagagcgagugcgucugcaucaacggcacgugcaccguggugaugaccgacggcuccgccagcgggaaggcggacaccaagauccuguucaucaaggagggcaagaucguccacacguccagccucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaaggccaacagcaagcugcagaucaaccgccaggugaucguggaccggggcaaccgguccggguacagcggcaucuucuccgucgagagcaagagcugcaucaaccgcugcuucuacguggagcugauccggggccgcaagcaggagaccgaggugcucuggaccuccaacagcaucgucguguucugcgggaccuccggcaccuacgggacgggcagcuggcccgacggggccgacaucaaccugaugccgaucuga

SEQ ID NO: 75861 - RNA, 1410 nt, Artificial Sequence
  derived and/or modified sequence opt1 from neuraminidase__InfluenzaA__ABD77634
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccaucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucaaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaaggccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcaccuacgggacgggcuccuggcccgacggggccgacaucaaccucaugccgaucuga

SEQ ID NO: 75862 - RNA, 1410 nt, Artificial Sequence; identical to SEQ ID NO: 75861
  derived and/or modified sequence opt1 from neuraminidase__InfluenzaA__ABD77645

SEQ ID NO: 75863 - RNA, 1410 nt, Artificial Sequence; identical to SEQ ID NO: 75861
  derived and/or modified sequence opt1 from neuraminidase__InfluenzaA__ABD77656

SEQ ID NO: 75864 - RNA, 1410 nt, Artificial Sequence; identical to SEQ ID NO: 75134
  derived and/or modified sequence opt1 from neuraminidase__InfluenzaA__ABD77700

SEQ ID NO: 75865 - RNA, 1413 nt, Artificial Sequence; identical to SEQ ID NO: 75836
  derived and/or modified sequence opt1 from neuraminidase__InfluenzaA__ABD77722

SEQ ID NO: 75866 - RNA, 1413 nt, Artificial Sequence; identical to SEQ ID NO: 75836
  derived and/or modified sequence opt1 from neuraminidase__InfluenzaA__ABD77733

SEQ ID NO: 75867 - RNA, 1410 nt, Artificial Sequence
  derived and/or modified sequence opt1 from neuraminidase__InfluenzaA__ABD77744
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacgagaacgcgaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggccgacaccaagauccuguucaucgaggagggcaagaucgugcacacgagccugcucagcggguccgcgcagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcuggucggcgacacgccccgcaagaacgacagcuccagcuccagccacugccuggaccccaacaacgaggagggcgggcacggggugaagggcugggccuucgacgacggcaacgacgucuggauggggcggaccaucuccgagaagcuccgcagcggcuacgagaccuucaaggugaucgaggggugguccaagcccaacagcaagcugcagaucaaccgccaggugaucgucgaccggggcaaccgguccggguacagcggcaucuucuccguggagggcaagagcugcaucaaccgcugcuucuacguggagcugauccgggggcgcaagcaggagaccgagguccucuggaccagcaacuccaucgugguguucugcggcaccagcgggaccuacggcacgggguccuggccggacggcgccgacaucaaccugaugcccaucuga

SEQ ID NO: 75868 - RNA, 1410 nt, Artificial Sequence; identical to SEQ ID NO: 75861
  derived and/or modified sequence opt1 from neuraminidase__InfluenzaA__ABD77755

SEQ ID NO: 75869 - RNA, 1410 nt, Artificial Sequence; identical to SEQ ID NO: 75861
  derived and/or modified sequence opt1 from neuraminidase__InfluenzaA__ABD77766

SEQ ID NO: 75870 - RNA, 1410 nt, Artificial Sequence
  derived and/or modified sequence opt1 from neuraminidase__InfluenzaA__ABD77777
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcccugcgagcccacgaucaucgagcgcaacaucaccgagaucguguaccucaccaacaccacgaucgagaaggagaucugcccgaagcuggccgaguaccggaacugguccaagccccagugcaacaucaccggguucgcgcccuucagcaaggacaacuccauccgccugagcgccggcggggacaucugggugacccgggagcccuacgucuccugcgacccggacaagugcuaccaguucgcccucggccaggggaccacgcugaacaacggccacagcaacgacaccgugcacgaccgcacccccuaccggacccugcucaugaacgagcugggcgugcccuuccaccuggggacgaagcaggucugcaucgccugguccagcuccagcugccacgacggcaaggccuggcuccacgugugcgugaccggggacgacgagaacgcgaccgccuccuucaucuacaacggccgccuggucgacagcaucggguccuggagcaagaagauccugcggacccaggaguccgagugcgugugcaucaacggcacgugcaccguggucaugaccgacggcagcgccuccgggaaggccgacaccaagauccucuucaucgaggagggcaagaucgugcacacgagccugcugagcggguccgcgcagcacguggaggagugcagcugcuacccccgcuacccgggcguccggugcgugugccgcgacaacuggaagggcuccaaccggcccaucguggacaucaacgucaaggacuacagcaucguguccagcuacgugugcuccgggcucgucggcgacacgccccgcaagaacgacagcuccagcuccagccacugccuggaccccaacaacgaggagggcgggcacggggugaagggcugggccuucgacgacggcaacgacgucuggauggggcggaccaucuccgagaagcugcgcagcggcuacgagaccuucaaggugaucgaggggugguccaagccgaacagcaagcuccagaucaaccgccaggugaucgucgaccggggcaaccgguccggguacagcggcaucuucuccguggagggcaagagcugcaucaaccgcugcuucuacguggagcugauccgggggcgcaagcaggagaccgagguccuguggaccagcaacuccaucgugguguucugcggcaccagcgggaccuacggcacgggguccuggcccgacggcgccgacaucaaccucaugcccaucuga

SEQ ID NO: 75871 - RNA, 1410 nt, Artificial Sequence; identical to SEQ ID NO: 75870
  derived and/or modified sequence opt1 from neuraminidase__InfluenzaA__ABD77788

SEQ ID NO: 75872 - RNA, 1362 nt, Artificial Sequence
  derived and/or modified sequence opt1 from neuraminidase__InfluenzaA__ABD77799
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccaggggaucaucaccuacaacgugguggccggccaggacuccaccagcgucauccugaccggcaacuccagccugugcccgauccgcgggugggccauccacuccaaggacaacggcauccggaucgggagcaagggcgacguguucgugauccgcgagcccuucaucuccugcagccaccucgagugccggacguucuuccugacccagggggcgcugcucaacgacaagcacuccaacggcaccgucaaggaccgcagccccuaccgggcccugauguccugccccgugggcgaggccccgagccccuacaacucccgcuucgagagcguggccugguccgccagcgcgugccacgacgggaugggcuggcugaccaucgggaucagcggccccgacaacggcgccgucgccgugcucaaguacaacgggaucaucacggagaccaucaaguccuggcggaagaagauccugcgcacccaggagagcgagugcacgugcgugaacggcuccugcuucaccaucaugaccgacgggcccagcaacggccuggccuccuacaagaucuucaagaucgagaaggggaaggucaccaagagcaucgagcucaacgcgccgaacucccacuacgaggagugcagcugcuaccccgacaccggcaaggugaugugcgugugccgggacaacuggcacggcuccaaccgccccugggucagcuucgaccagaaccuggacuaccagaucggguacaucugcuccggcguguucggggacaacccccggccgaaggacggcacggggagcugcggccccguguccgccgacggcgccaacggggucaagggcuucagcuaccgcuacgggaacggcguguggaucgggcggaccaaguccgacagcucccgccacggcuucgagaugaucugggaccccaacggcuggaccgagaccgacagccgguucuccgugcgccaggacgucguggccaugacggaccggagcggguacagcggcuccuucgugcagcaccccgagcugaccgggcucgacugcaugcgcccgugcuucugggucgagcugauccggggccgccccgaggaggagaccaucuggaccagcggcuccaucaucagcuucugcggggugaacuccgacacggucgacuggagcuggcccgacggcgccgagcugcccuucaccaucgacaaguga

SEQ ID NO: 75873 - RNA, 1410 nt, Artificial Sequence
  derived and/or modified sequence opt1 from neuraminidase__InfluenzaA__ABD77810
augaaccccaaccagaagaucaucaccaucggcagcaucugcaugguggucgggaucaucucccugauccuccagaucggcaacaucgugagcaucuggaucucccacagcauccagaccgggaaccagaaccacacggggaccugcaaccaguccaucaucaccuacaagaacagcaccugggugaaccagacguacgucaacaucuccaacaccaacgugguggccggcaaggacaccaccagcgucauccuggccggcaacuccagccugugcccgauccgcggcugggcgaucuacuccaaggacaacggggugcggaucggcagcaagggggacguguucgucauccgcgagcccuucaucuccugcagccaccucgagugccggacguucuuccugacccagggcgcccugcucaacgacaagcacuccaacgggaccgugaaggaccgcagccccuaccgggcccugauguccugccccgugggcgaggccccgagccccuacaacucccgcuucgagagcgucgccuggagcgcguccgccugccacgacggcaugggguggcugaccaucggcaucagcgggcccgacgacggcgccguggccgugcucaaguacaacggcaucaucacggagaccaucaaguccuggcggaaggagauccugcgcacccaggagagcgagugcgucugcgugaacggguccugcuucaccaucaugacggacggccccagcgggggcccggcguccuacaagaucuucaagaucgagaaggggaaggugaccaagagcaucgagcuggacgcccccaacucccacuacgaggagugcagcugcuaccccgacaccuccaaggucaugugcgugugccgggacaacuggcacggcagcaaccgccccuggguguccuucgaccagaaccucgacuaccagaugggcuacaucugcagcggggucuucggcgacaacccgcggcccaaggacgggaagggcuccugcgggcccguguacguggacggcgccaacggcgucaagggguucagcuaccgcuacggcaacgggguguggaucggccggaccaaguccaacagcucccgccagggguucgagaugaucugggaccccaacggcuggacggagaccgacagcaacuucuucaccaagcaggacgucguggccgugaccgacuggagcggcuacuccgggagcuucguccagcacccggagcugacgggccuggacugcaugcggcccugcuucuggguggagcucauccgcgggcggcccaaggagaacaccaucuggaccuccggcagcuccaucagcuucugcggcgugaacuccgacaccgucgacuggagcuggcccgacggggccgagcugccguucacgaucgacaaguga

SEQ ID NO: 75874 - RNA, 1410 nt, Artificial Sequence
  derived and/or modified sequence opt1 from neuraminidase__InfluenzaA__ABD77832
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgggggccggcugguggacagcaucggguccuggagcaagaagauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacuccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccugaaccccaacaacgaggagggcgggcacggggucaagggcugggccuucgacgacggcaacgacguguggauggggcggaccaucagcgagaaguuccgcuccggcuacgagaccuucaaggucaucgggggcuggagcaagcccaacuccaagcugcagaucaaccgccaggugaucguggaccgggggaaccggagcggcuacuccggcaucuucagcgucgagggcaagagcugcaucaaccgcugcuucuacguggagcucauccgggggcgcaagcaggagaccgaggugugguggacguccaacagcaucgucguguucugcgggaccuccggcaccuacgggaccggcagcuggccggacggcgccgacaucaaccugaugcccaucuga

SEQ ID NO: 75875 - RNA, 1410 nt, Artificial Sequence
  derived and/or modified sequence opt1 from neuraminidase__InfluenzaA__ABD77876
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacuccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcugcgcuccggguacgagaccuucaaggucaucgagggcuggagcaagcccaacuccaagcuccagaucaaccgccaggugaucguggaccgggggaaccggagcggcuacuccgggaucuucagcgucgagggcaagagcugcaucaaccgcugcuucuacguggagcugauccggggccgcaagcaggagaccgaggugugguggacguccaacagcaucgucguguucugcgggaccuccggcaccuacgggaccggcagcuggccggacggggccgacaucaaccugaugcccaucuga

SEQ ID NO: 75876 - RNA, 1410 nt, Artificial Sequence; identical to SEQ ID NO: 75134
  derived and/or modified sequence opt1 from neuraminidase__InfluenzaA__ABD77887

SEQ ID NO: 75877 - RNA, 1410 nt, Artificial Sequence
  derived and/or modified sequence opt1 from neuraminidase__InfluenzaA__ABD77898
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucauccacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagccacugccugaaccccaacaacgaggagggcgggcacggcgugaaggggugggccuucgacgacggcuccgacgucuggaugggccggaccaucagcgagaagcugcgcuccggguacgagaccuucaaggugaucgagggcuggagcaagccgaacuccaagcuccagaucaaccggcaggucaucguggaccgcgggaaccggagcggcuacuccgggaucuucagcguggagggcaagagcugcaucaaccgcugcuucuacgucgagcugauccggggccgcaagcaggagaccgaggugugguggacguccaacagcaucguggucuucugcgggaccuccggcaccuacgggaccggcagcuggcccgacggggccgacaucaaccugaugcccaucuga

SEQ ID NO: 75878 - RNA, 1410 nt, Artificial Sequence
  derived and/or modified sequence opt1 from neuraminidase__InfluenzaA__ABD77909
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagccgaacagcaagcuccagaucaaccgccaggugaucguggaccgggggaacuccagcggcuacuccgggaucuucagcgucgagggcaagagcugcaucaaccggugcuucuacguggagcugauccgcggccggaagcaggagaccgaggugugguggacguccaacagcaucgucguguucugcgggaccuccggcaccuacgggaccggcagcuggcccgacggggccgacaucaaccugaugcccaucuga

SEQ ID NO: 75879 - RNA, 1413 nt, Artificial Sequence; identical to SEQ ID NO: 75836
  derived and/or modified sequence opt1 from neuraminidase__InfluenzaA__ABD77920

SEQ ID NO: 75880 - RNA, 1413 nt, Artificial Sequence; identical to SEQ ID NO: 75836
  derived and/or modified sequence opt1 from neuraminidase__InfluenzaA__ABD77931

SEQ ID NO: 75881 - RNA, 1413 nt, Artificial Sequence; identical to SEQ ID NO: 75836
  derived and/or modified sequence opt1 from neuraminidase__InfluenzaA__ABD77942

SEQ ID NO: 75882 - RNA, 1413 nt, Artificial Sequence
  derived and/or modified sequence opt1 from neuraminidase__InfluenzaA__ABD77953
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggagcggguacagcggcuccuucguccagcaccccgagcucaccggccuggacugcauccgccccugcuuccugguggagcucguccgggggcugccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75883 - RNA, 1413 nt, Artificial Sequence
  derived and/or modified sequence opt1 from neuraminidase__InfluenzaA__ABD77964
augaaccccaaccagaagaucaucaccaucggcagcaucuccaucgccaucgggaucaucagccugaugcuccagaucggcaacaucaucuccaucugggccagccacuccauccagacccgcagccagaaccacacggggaucugcaaccagcggaucaucaccuacgagaacuccaccugggugaaccacaccuacgucaacaucaacaacacgaacgugguggcgggcaaggacaagaccagcgucacccuggccgggaacuccagccugugcuccaucagcggcugggccaucuacaccaaggacaacuccauccgcaucggcagcaagggggacguguucgugauccgggagccguucaucuccugcagccaccucgagugccgcacguucuuccugacccagggcgcccugcucaacgacaagcacuccaacgggaccgucaaggaccggagccccuaccgcgcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcagcggcguguucggcgacaacccccggcccaaggacggggagggcuccugcaacccggugacggucgacggggcggacggcgugaagggguucagcuacaaguacggcaacggcguguggaucgggcgcaccaaguccaaccggcugcgcaagggcuucgagaugaucugggaccccaacggguggaccgacaccgacagcaacuucuccgucaagcaggacgugguggccaucacggacuggagcggcuacagcggguccuucguccagcaccccgagcucaccggccuggacugcauccggcccugcuucuggguggagcugguccgcggccucccgcgggagaacaccaccaucuggacgagcggguccagcaucuccuucugcggcgugaacagcgacaccgccaacugguccuggcccgacggggccgagcugcccuucaccaucgacaaguga

SEQ ID NO: 75884 - RNA, 1413 nt, Artificial Sequence; identical to SEQ ID NO: 75836
  derived and/or modified sequence opt1 from neuraminidase__InfluenzaA__ABD77975

SEQ ID NO: 75885 - RNA, 1413 nt, Artificial Sequence; identical to SEQ ID NO: 75836
  derived and/or modified sequence opt1 from neuraminidase__InfluenzaA__ABD77986

SEQ ID NO: 75886 - RNA, 1413 nt, Artificial Sequence
  derived and/or modified sequence opt1 from neuraminidase__InfluenzaA__ABD77997
augaaccccaaccagaagaucaucaccaucggcagcaucuccaucgccaucgggauccugagccucaugcugcagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccucugcuccaucagcggcugggccaucuacaccaaggacaacuccauccggaucgggagcaagggcgacguguucgugauccgcgagccguucaucuccugcagccaccuggagugccggacguucuuccugacccagggggcccuccugaacgacaagcacuccaacggcaccgucaaggaccgcagccccuaccgggcccugauguccugcccccucggggaggcgcccagcccguacaacagcaaguucgaguccguggccuggagcgccuccgccugccacgacggcaugggcuggcugaccaucgggaucagcggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccagcaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacaacaacuucagcgucaagcaggacgugguggccaucacggacugguccggguacagcggcagcuucguccagcaccccgagcugaccggccuggacugcauccgccccugcuucuggguggagcucguccgggggcugccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 75887 - RNA, 1413 nt, Artificial Sequence; identical to SEQ ID NO: 75836
  derived and/or modified sequence opt1 from neuraminidase__InfluenzaA__ABD78008

SEQ ID NO: 75888 - RNA, 1413 nt, Artificial Sequence; identical to SEQ ID NO: 75836
  derived and/or modified sequence opt1 from neuraminidase__InfluenzaA__ABD78019

SEQ ID NO: 75889 - RNA, 1413 nt, Artificial Sequence
  derived and/or modified sequence opt1 from neuraminidase__InfluenzaA__ABD78030
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaaccgcaccgucaaggaccggagccccuaccgcgcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcgugaacggcuccugcuucaccaucaugacggacggccccaacaacggggccgccagcuacaagaucuucaagaucgagaagggcaaggucaccaaguccaucgagcucaacgcccccaacuuccacuacgaggagugcagcugcuacccggacaccgggaccgugaugugcgugugccgggacaacuggcacggcuccaaccgccccugggucagcuucaaccagaaccuggacuaccagaucggguacaucugcuccggcguguucggcgacaacccccggcccaaggacggggagggcagcugcaacccggugacggucgacggggcggacggcgugaagggguucuccuacaaguacggcaacggcguguggaucgggcgcaccaagagcaaccggcugcgcaagggcuucgagaugaucugggaccccaacggguggaccgacaccgacuccaacuucagcgucaagcaggacgugguggccaucacggacugguccggcuacagcgggagcuucguccagcaccccgagcucaccggccuggacugcauccggcccugcuucuggguggagcugguccgcggccucccgcgggagaacaccaccaucuggacguccgggagcuccaucagcuucugcggcgugaacuccgacaccgccaacuggagcuggcccgacggggccgagcugcccuucaccaucgacaaguga

SEQ ID NO: 75890 - RNA, 1413 nt, Artificial Sequence
  derived and/or modified sequence opt1 from neuraminidase__InfluenzaA__ABD78041
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccagcaccgugaugugcgugugccgcgacaacuggcacggcuccaaccggcccugggucagcuucaaccagaaccuggacuaccagaucggguacaucugcuccggcguguucggcgacaacccccgccccaaggacggggagggcagcugcaacccggugacggucgacggggcggacggcgugaagggguucuccuacaaguacggcaacggcguguggaucgggcggaccaagagcaaccgccugcggaagggcuucgagaugaucugggaccccaacggguggaccgacaccgacuccaacuucagcgucaagcaggacgugguggccaucacggacuggagcggcuacuccgggagcuucguccagcaccccgagcucaccggccuggacugcauccgccccugcuucuggguggagcugguccggggccucccgcgcgagaacaccaccaucuggacguccgggagcuccaucagcuucugcggcgugaacuccgacaccgccaacuggagcuggcccgacggggccgagcugcccuucaccaucgacaaguga

SEQ ID NO: 75891 - RNA, 1410 nt, Artificial Sequence; identical to SEQ ID NO: 75870
  derived and/or modified sequence opt1 from neuraminidase__InfluenzaA__ABD78052

SEQ ID NO: 75892 - RNA, 1413 nt, Artificial Sequence; identical to SEQ ID NO: 75404
  derived and/or modified sequence opt1 from neuraminidase__InfluenzaA__ABD78063

SEQ ID NO: 75893 - RNA, 1413 nt, Artificial Sequence; identical to SEQ ID NO: 75404
  derived and/or modified sequence opt1 from neuraminidase__InfluenzaA__ABD78074

SEQ ID NO: 75894 - RNA, 1413 nt, Artificial Sequence; identical to SEQ ID NO: 75404
  derived and/or modified sequence opt1 from neuraminidase__InfluenzaA__ABD78085

SEQ ID NO: 75895 - RNA, 1413 nt, Artificial Sequence; identical to SEQ ID NO: 75404
  derived and/or modified sequence opt1 from neuraminidase__InfluenzaA__ABD78096

SEQ ID NO: 75896 - RNA, 1410 nt, Artificial Sequence
  derived and/or modified sequence opt1 from neuraminidase__InfluenzaA__ABD78118
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacuccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaaguuccgcuccggguacgagaccuucaaggucaucggcggguggagcaagcccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugugguggacguccaacagcaucgucguguucugcggcaccuccgggaccuacggcaccgggagcuggccggacggcgccgacaucaaccugaugcccaucuga

SEQ ID NO: 75897 - RNA, 1410 nt, Artificial Sequence; identical to SEQ ID NO: 75896
  derived and/or modified sequence opt1 from neuraminidase__InfluenzaA__ABD78129

SEQ ID NO: 75898 - RNA, 1410 nt, Artificial Sequence; identical to SEQ ID NO: 75126
  derived and/or modified sequence opt1 from neuraminidase__InfluenzaA__ABD79035

SEQ ID NO: 75899 - RNA, 1353 nt, Artificial Sequence
  derived and/or modified sequence opt1 from neuraminidase__InfluenzaA__ABD79115
augaaccccaaccagaagaucaucaccaucggcagcaucugcaugguggucgggaucaucucccugaucuuccagaucggcaacaucgugagcaucuggaucucccacagcaucaccgggacgugcaaccgcuccaucuacgugaacaucagcaacaccaacgucguggccggcaaggacaccaccuccgugauccucgccgggaacagcucccugugcccgauccggggcugggcgaucuacagcaaggacaacggcguccgcaucggguccaagggcgacguguucgugauccgggagcccuucaucagcugcucccaccuggagugccgcacguucuuccucacccagggggcccugcugaacgacaagcacagcaacggcaccgucaaggaccggucccccuaccgcacccucaugagcugccccgugggggaggccccgucccccuacaacagccgguucgaguccguggccuggagcgccagcgcgugccacgacggcaugggcuggcugacgaucgggaucuccggccccgacgacggggccgucgccgugcugaaguacaacggcaucaucaccggcaccaucaagagcuggcgcaaggagauccuccggacccaggaguccgagugcgugugcgucaacgggagcugcuucacgaucaugaccgacggccccuccgggggcccggccagcuacaagaucuucaagaucgagaaggggaaggugaccaaguccaucgagcuggacgcgcccaacagccacuacgaggagugcuccugcuaccccgacaccagcaaggugaugugcgucugccgcgacaacuggcacggcuccaaccggcccugggugagcuucgaccagaaccuggacuaccagaugggcuacaucugcuccgggguguucggcgacaacccgcgccccaaggacgggaagggcagcugcgggcccgucuacguggacggcgccaacggcgugaagggguucuccuaccgguacggcaacggggucuggaucggccgcaccaagagcuccagcucccggcagggguucgagaugaucugggaccccaacggcuggacggagaccgacagcaacuucuucaugaagcaggacguggucgccgugaccgacuggagcggcuacuccgggagcuucgugcagcacccggagcucacgggccuggacugcaugcgccccugcuucugggucgagcugauccgggggcgccccaaggagaacaccaucuggaccuccggcagcuccaucagcuucugcggcgugaacuccgacaccguggacuggagcuggcccgacggggccgagcucccguucacgaucgacaaguga

SEQ ID NO: 75900 - RNA, 1410 nt, Artificial Sequence
  derived and/or modified sequence opt1 from neuraminidase__InfluenzaA__ABD79126
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagcccccugagcggguccgcgcagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccuggaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggacaaggggaaccgguccggcuacagcggcaucuucuccgucgagggcaagagcugcaucaaccggugcuucuacguggagcugauccgcgggcggaagcaggagaccgaggugugguggacgagcaacuccaucgucguguucugcgggaccagcggcaccuacgggaccggcuccuggcccgacggcgccgacaucaaccugaugcccaucuga

SEQ ID NO: 75901 - RNA, 1410 nt, Artificial Sequence; identical to SEQ ID NO: 75900
  derived and/or modified sequence opt1 from neuraminidase__InfluenzaA__ABD79137

SEQ ID NO: 75902 - RNA, 1410 nt, Artificial Sequence; identical to SEQ ID NO: 75900
  derived and/or modified sequence opt1 from neuraminidase__InfluenzaA__ABD79148

SEQ ID NO: 75903 - RNA, 1410 nt, Artificial Sequence; identical to SEQ ID NO: 75900
  derived and/or modified sequence opt1 from neuraminidase__InfluenzaA__ABD79159

SEQ ID NO: 75904 - RNA, 1410 nt, Artificial Sequence
  derived and/or modified sequence opt1 from neuraminidase__InfluenzaA__ABD79170
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacaacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucaaggagggcaagaucguccacgugagcccccugagcggguccgcgcagcacguggaggagugcagcugcuacccccgcuacccgggcguccggugcgugugccgcgacaacuggaagggcuccaaccggcccaucguggacaucaacgucaaggacuacagcaucguguccagcuacgugugcuccgggcucgucggcgacacgccccgcaagaacgacagcuccagcuccagcuacugccuggaccccaacaacgaggagggcgggcacggggugaagggcugggccuucgacgacggcaacgacgucuggauggggcggaccaucuccgagaagcugcgcagcggcuacgagaccuucaaggugaucgggggcugguccaagccgaacagcaagcuccagaucaaccgccaggugaucgucgacaaggggaaccgguccggcuacagcggcaucuucuccguggagggcaagagcugcaucaaccggugcuucuacguggagcugauccgcgggcggaagcaggagaccgaggucugguggacgagcaacuccaucgugguguucugcgggaccagcggcaccuacgggaccggcuccuggcccgacggcgccgacaucaaccugaugcccaucuga

SEQ ID NO: 75905 - RNA, 1410 nt, Artificial Sequence; identical to SEQ ID NO: 75900
  derived and/or modified sequence opt1 from neuraminidase__InfluenzaA__ABD79181

SEQ ID NO: 75906 - RNA, 1410 nt, Artificial Sequence; identical to SEQ ID NO: 75900
  derived and/or modified sequence opt1 from neuraminidase__InfluenzaA__ABD79192

SEQ ID NO: 75907 - RNA, 1410 nt, Artificial Sequence
  derived and/or modified sequence opt1 from neuraminidase__InfluenzaA__ABD79203
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaagugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagcccccugagcggguccgcgcagcacguggaggagugcagcugcuacccccgcuacccgggcgugcggugcgucugccgcgacaacuggaagggcuccaaccggcccaucguggacaucaacaugaaggacuacagcaucguguccagcuacgucugcuccgggcucgugggcgacacgccccgcaagaacgacagcuccagcuccagcuacugccuggaccccaacaacgaggagggcgggcacggggugaagggcugggccuucgacgacggcaacgacgucuggauggggcggaccaucuccgagaagcugcgcagcggcuacgagaccuucaaggugaucgggggcugguccaagccgaacagcaagcuccagaucaaccggcaggucaucguggacaaggggaaccgcuccggcuacagcggcaucuucuccguggagggcaagagcugcaucaaccggugcuucuacgucgagcugauccgcgggcggaagcaggagaccgaggugugguggacgagcaacuccaucguggucuucugcgggaccagcggcaccuacgggaccggcuccuggcccgacggcgccgacaucaaccugaugcccaucuga

SEQ ID NO: 75908 - RNA, 1410 nt, Artificial Sequence; identical to SEQ ID NO: 75900
  derived and/or modified sequence opt1 from neuraminidase__InfluenzaA__ABD79214

SEQ ID NO: 75909 - RNA, 1410 nt, Artificial Sequence
  derived and/or modified sequence opt1 from neuraminidase__InfluenzaA__ABD79236
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacaacaccgcccacgaccggaccccguaccgcacccuccugaugaacgagcugggcguccccuuccaccucgggacgaagcaggucugcaucgccugguccagcuccagcugccacgacggcaaggcguggcugcacgugugcgugaccgggcacaacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgccuccgggcgggcggacaccaagauccuguucaucaaggagggcaagaucgugcacaucagcccccugagcggguccgcccagcacgucgaggagugcagcugcuacccccgcuacccgggcgugcggugcgugugccgcgacaacuggaagggcuccaaccggcccaucgucgacaucaacgugaaggacuacagcaucguguccagcuacgucugcuccgggcucgugggcgacacgccccgcaagaacgacagcuccagcuccagcuacugccuggaccccaacaacgaggagggcgggcacggggugaagggcugggccuucgacgacggcaacgacgucuggauggggcggaccaucuccgagaagcugcgcagcggcuacgagaccuucaaggugaucgggggcugguccaagccgaacagcaagcuccagaucaaccggcaggucaucguggacaaggggaaccgcuccggcuacagcggcaucuucuccguggagggcaagagcugcaucaaccggugcuucuacgucgagcugauccgcgggcggaagcaggagaccgaggugugguggacgagcaacuccaucguggucuucugcgggaccagcggcaccuacgggaccggcuccuggcccgacggcgccgacaucaaccugaugcccaucuga

SEQ ID NO: 75910 - RNA, 1410 nt, Artificial Sequence
  derived and/or modified sequence opt1 from neuraminidase__InfluenzaA__ABD79247
augaaccccaaccagaagaucaucaccaucggcagcgugucccugaccaucacgaccaucugcuuccucaugcagaucgccauccuggucaucaccgugacccugcacuucaagcagugcgagugcaacccgccgcccaacaaccaggugaugcucugcgagcccacgaucaucgagcgcaacaucaccgagaucgucuaccugaccaacaccacgaucgagaaggagaucugccccaagcuggccgaguaccggaacuggagcaagccccagugcaagaucaccggguucgcgcccuucuccaaggacaacagcauccgccucuccgccggcggggacaucugggugacccgggagcccuacgugagcugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccagcuccugccacgacggcaaggccuggcugcacgugugcgugaccgggcacaacgagaacgcgaccgccagcuucaucuacgacggccggcugguggacuccaucgggagcugguccaagaacauccuccgcacccaggagagcgagugcgucugcaucaacggcacgugcaccguggugaugaccgacggcuccgccagcgggcgggccgacaccaagauccuguucaucgaggagggcaagaucguccacaucagcccccuguccgggagcgcgcagcacguggaggagugcuccugcuacccgcgcuaccccggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugccuggacccgaacaacgaggagggcgggcacggggucaagggcugggccuucgacgacggcaacgacguguggauggggcggaccaucagcgagaagcugcgcuccggcuacgagaccuucaaggucaugggcggguggagcaagcccaacuccaagcuccagaucaaccgccaggugaucguggaccgggggaaccggagcggcuacuccggcaucuucagcgucgaggggaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggcgccgacaucaaccugaugcccaucuga

SEQ ID NO: 75911 - RNA, 1410 nt, Artificial Sequence; identical to SEQ ID NO: 75335
  derived and/or modified sequence opt1 from neuraminidase__InfluenzaA__ABD94737

SEQ ID NO: 75912 - RNA, 1410 nt, Artificial Sequence; identical to SEQ ID NO: 75720
  derived and/or modified sequence opt1 from neuraminidase__InfluenzaA__ABD94748

SEQ ID NO: 75913 - RNA, 1413 nt, Artificial Sequence; identical to SEQ ID NO: 75836
  derived and/or modified sequence opt1 from neuraminidase__InfluenzaA__ABD94759

SEQ ID NO: 75914 - RNA, 1410 nt, Artificial Sequence; identical to SEQ ID NO: 75069
  derived and/or modified sequence opt1 from neuraminidase__InfluenzaA__ABD94770

SEQ ID NO: 75915 - RNA, 1413 nt, Artificial Sequence; identical to SEQ ID NO: 75404
  derived and/or modified sequence opt1 from neuraminidase__InfluenzaA__ABD94792

SEQ ID NO: 75916 - RNA, 1413 nt, Artificial Sequence; identical to SEQ ID NO: 75404
  derived and/or modified sequence opt1 from neuraminidase__InfluenzaA__ABD94803

SEQ ID NO: 75917 - RNA, 1413 nt, Artificial Sequence; identical to SEQ ID NO: 75404
  derived and/or modified sequence opt1 from neuraminidase__InfluenzaA__ABD94814

SEQ ID NO: 75918 - RNA, 1410 nt, Artificial Sequence; identical to SEQ ID NO: 75581
  derived and/or modified sequence opt1 from neuraminidase__InfluenzaA__ABD94825

SEQ ID NO: 75919 - RNA, 1410 nt, Artificial Sequence
  derived and/or modified sequence opt1 from neuraminidase__InfluenzaA__ABD94847
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccaagaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgccugguccagcuccagcugccacgacgggaaggcguggcugcacgugugcgugacgggccacgacgagaacgccaccgccuccuucaucuacgacgggcggcugguggacagcaucggcuccuggagcaagaagauccuccgcacccaggaguccgagugcgucugcaucaacgggaccugcacgguggugaugaccgacggcagcgccuccggccgggcggucaccaagauccuguucaucgaggaggggaagaucgugcacaucagcccccugcucggcagcgcccagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccuggucggggacacgccccgcaagaacgacuccagcuccagcucccacugccugaaccccaacaacgaggagggcgggcacggcgugaaggggugggccuucgacgacggcaacgacgucuggaugggccggaccaucagcgagaagcuccgcuccggguacgagaccuucaaggugaucgagggcuggagcaagccgaacuccaagcugcagaucaaccgccaggugaucgucgaccgggggaaccggagcggcuacuccgggaucuucagcguggagggcaaguccugcaucaaccgcugcuucuacguggagcugauccggggccgcaagcaggagaccgaggucugguggaccagcaacagcaucgugguguucugcgggacguccggcaccuacgggaccggcagcuggcccgacggggccgacaucaaccucaugcccaucuga

SEQ ID NO: 75920 - RNA, 1410 nt, Artificial Sequence; identical to SEQ ID NO: 75134
  derived and/or modified sequence opt1 from neuraminidase__InfluenzaA__ABD94858

SEQ ID NO: 75921 - RNA, 1410 nt, Artificial Sequence; identical to SEQ ID NO: 75134
  derived and/or modified sequence opt1 from neuraminidase__InfluenzaA__ABD94880

SEQ ID NO: 75922 - RNA, 1410 nt, Artificial Sequence
  derived and/or modified sequence opt1 from neuraminidase__InfluenzaA__ABD94891
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagguccuguucaucgaggagggcaagaucgugcacaucagccagcugagcggguccgcgcagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcucgucggcgacacgccccgcaagaacgacagcuccagcuccagcuacugccuggaccccaacaacgaggagggcgggcacggggugaagggcugggccuucgacgacggcaacgacgucuggauggggcggaccaucuccgagaagcugcgcagcggcuacgagaccuucaaggugaucgggggcugguccaagcccaacagcaagcuccagaucaaccgccaggugaucgucgaccgggggaaccgguccggcuacagcggcaucuucuccguggagggcaagagcugcaucaaccgcugcuucuacguggagcugauccgggggcgcaagcaggagaccgaggucugguggacgagcaacuccaucgugguguucugcgggaccagcggcaccuacgggaccggcuccuggccggacggcgccgacaucaaccugaugcccaucuga

SEQ ID NO: 75923 - RNA, 1410 nt, Artificial Sequence; identical to SEQ ID NO: 75900
  derived and/or modified sequence opt1 from neuraminidase__InfluenzaA__ABD94902

SEQ ID NO: 75924 - RNA, 1410 nt, Artificial Sequence
  derived and/or modified sequence opt1 from neuraminidase__InfluenzaA__ABD94924
augaaccccaaccagaagaucaucaccaucggcagcgugucccugaccaucgccacgaucugccuccugaugcagaucgccauccuggucaccaccgugacccuccacuucaagcaguacgagugcaacagcccgcccaacaaccaggugaugcugugcgagcccacgaucaucgagcgcaacaucaccgagaucgucuaccugaccaacaccacgaucgagaaggagaucugccccaagcucgcggaguaccggaacugguccaagccgcagugcaagaucaccggguucgcccccuucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggaccccguaccgcacccugcugaugaacgagcucggcgugcccuuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucguccacaucagccagcuccugggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccuggugggggacacgccccgcaagaacgacuccagcuccagcucccacugccucaaccccaacaacgaggagggcgggcacggcgucaaggggugggccuucgacgacggcaacgacguguggaugggccggaccaucagcgagaagcugcgcuccggguacgagaccuucaaggucaucgagggcuggagcaagcccaacuccaagcugcagaucaaccgccaggugaucguggaccgggggaaccggagcggcuacuccgggaucuucagcgucgagggcaaguccugcaucaaccgcugcuucuacguggagcucauccggggccgcaagcaggagaccgaggugugguggacgagcaacagcaucgucguguucugcgggaccuccggcaccuacgggaccggcagcuggccggacggggccgacaucaaccugaugcccaucuga

SEQ ID NO: 75925 - RNA, 1410 nt, Artificial Sequence
  derived and/or modified sequence opt1 from neuraminidase__InfluenzaA__ABD94946
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgaccggagcuccagcucccacugccuggaccccaacaacgaggagggcggccacggggucaagggcugggccuucgacgacggcaacgacguguggauggggcgcaccaucagcgagaagcuccgguccggcuacgagaccuucaaggucaucgagggguggagcaagcccaacuccaagcugcagaucaaccgccaggugaucguggaccgggacaaccgcagcggcuacuccgggaucuucagcgucgagggcaaguccugcaucaaccggugcuucuacguggagcugauccgcggccggaaccaggagaccgaggugcucuggaccagcaacagcaucgucguguucugcgggaccuccggcacguacgggaccggcagcuggccggacggggccgacaucaaccugaugcccaucuga

SEQ ID NO: 75926 - RNA, 1410 nt, Artificial Sequence
  derived and/or modified sequence opt1 from neuraminidase__InfluenzaA__ABD94957
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagagcaaguccugcaucaaccgcugcuucuacguggagcucauccgggggcgcaaggaggagaccgaggugcuguggaccagcaacuccaucgucguguucugcggcaccagcggcacguacgggaccggcuccuggccggacggggccgacaucaaccugaugcccaucuga

SEQ ID NO: 75927 - RNA, 1413 nt, Artificial Sequence; identical to SEQ ID NO: 75836
  derived and/or modified sequence opt1 from neuraminidase__InfluenzaA__ABD94968

SEQ ID NO: 75928 - RNA, 1413 nt, Artificial Sequence; identical to SEQ ID NO: 75836
  derived and/or modified sequence opt1 from neuraminidase__InfluenzaA__ABD94990

SEQ ID NO: 75929 - RNA, 1413 nt, Artificial Sequence
  derived and/or modified sequence opt1 from neuraminidase__InfluenzaA__ABD95001
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacauccacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccaugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 75930 - RNA, 1413 nt, Artificial Sequence
  derived and/or modified sequence opt1 from neuraminidase__InfluenzaA__ABD95012
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcaacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75931 - RNA, 1413 nt, Artificial Sequence; identical to SEQ ID NO: 75836
  derived and/or modified sequence opt1 from neuraminidase__InfluenzaA__ABD95023

SEQ ID NO: 75932 - RNA, 1413 nt, Artificial Sequence
  derived and/or modified sequence opt1 from neuraminidase__InfluenzaA__ABD95034
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggagcggguacagcggcuccuucauccagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 75933 - RNA, 1413 nt, Artificial Sequence
  derived and/or modified sequence opt1 from neuraminidase__InfluenzaA__ABD95056
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaagaucaccaagagcaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccugaacugcauccggcccugcuucugggucgagcuggugcgcgggcucccgaaggagaacaccaccaucuggacgagcggcuccagcaucuccuucugcggggucaacagcgacaccgccaacugguccuggcccgacggcgccgagcugcccuucaccaucgacaaguga

SEQ ID NO: 75934 - RNA, 1413 nt, Artificial Sequence; identical to SEQ ID NO: 75404
  derived and/or modified sequence opt1 from neuraminidase__InfluenzaA__ABD95067

SEQ ID NO: 75935 - RNA, 1413 nt, Artificial Sequence; identical to SEQ ID NO: 75404
  derived and/or modified sequence opt1 from neuraminidase__InfluenzaA__ABD95078

SEQ ID NO: 75936 - RNA, 1413 nt, Artificial Sequence; identical to SEQ ID NO: 75933
  derived and/or modified sequence opt1 from neuraminidase__InfluenzaA__ABD95089

SEQ ID NO: 75937 - RNA, 1413 nt, Artificial Sequence; identical to SEQ ID NO: 75404
  derived and/or modified sequence opt1 from neuraminidase__InfluenzaA__ABD95100

SEQ ID NO: 75938 - RNA, 1413 nt, Artificial Sequence
  derived and/or modified sequence opt1 from neuraminidase__InfluenzaA__ABD95111
augaaccccaaccagaagaucaucaccaucggcagcaucuccaucgccaucgggaugaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 75939 - RNA, 1413 nt, Artificial Sequence; identical to SEQ ID NO: 75938
  derived and/or modified sequence opt1 from neuraminidase__InfluenzaA__ABD95122

SEQ ID NO: 75940 - RNA, 1413 nt, Artificial Sequence; identical to SEQ ID NO: 75404
  derived and/or modified sequence opt1 from neuraminidase__InfluenzaA__ABD95144

SEQ ID NO: 75941 - RNA, 1413 nt, Artificial Sequence; identical to SEQ ID NO: 75404
  derived and/or modified sequence opt1 from neuraminidase__InfluenzaA__ABD95155

SEQ ID NO: 75942 - RNA, 1413 nt, Artificial Sequence
  derived and/or modified sequence opt1 from neuraminidase__InfluenzaA__ABD95166
augaaccccaaccagaagaucaucaccaucggcagcaucuccaucgccaucgggaugaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcgcacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcagcggcguguucggcgacaacccccggcccaaggacggggagggcuccugcaacccggugacggucgacggggcgaacggcgugaagggguucagcuacaaguacggcaacggcguguggaucgggcgcaccaaguccaaccggcugcgcaagggcuucgagaugaucugggaccccaacggguggaccgacaccgacagcgacuucuccgucaagcaggacgugguggccaucacggacuggagcggcuacagcggguccuucguccagcaccccgagcucaccggccuggacugcauccggcccugcuucuggguggagcugguccgcggccucccgaaggagaacaccaccaucuggacgagcggguccagcaucuccuucugcggcgugaacagcgacaccgccaacugguccuggcccgacggggccgagcugcccuucaccaucgacaaguga

SEQ ID NO: 75943 - RNA, 1413 nt, Artificial Sequence; identical to SEQ ID NO: 75933
  derived and/or modified sequence opt1 from neuraminidase__InfluenzaA__ABD95177

SEQ ID NO: 75944 - RNA, 1413 nt, Artificial Sequence
  derived and/or modified sequence opt1 from neuraminidase__InfluenzaA__ABD95188
augaaccccaaccagaagaucaucaccaucggcagcaucuccaccacgaucgggaucaucagccugaugcuccagaucggcaacaucaucuccaucugggccagccacuccauccagaccgggagccagaaccacaccggcgugugcaaccagcgcaucaucaccuacgagaacuccacgugggucaaccacaccuacgugaacaucaacaacaccaacgugaucgccgggaaggacaagaccagcgucacgcuggcgggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacccagggggcccugcucaacgacaagcacuccaacggcacggucaaggaccgcagccccuaccgggcccugauguccugcccccugggggaggcccccagcccguacaacagcaaguucgaguccguggcguggagcgccuccgccugccacgacggcaugggcuggcucaccaucgggaucagcggccccgacaacggggccguggcgguccugaaguacaacggcaucaucaccgagaccaucaaguccuggaagaagcagauccugcgcacgcaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugaccgucgacggcgccaacggggugaagggcuucagcuacaaguacggcaacgggguguggaucggccgcaccaaguccaaccggcugcgcaagggguucgagaugaucugggaccccaacggcuggacggacaccgacagcgacuucuccgucaagcaggacgugguggcgaucaccgacuggagcggguacagcggcuccuucguccagcaccccgagcucaccggccuggacugcauccggcccugcuucuggguggagcugguccgcgggcucccgaaggagaacacgaccaucuggaccagcggcuccagcaucuccuucugcggggugaacagcgacaccgccaacugguccuggcccgacggcgccgagcugcccuucacgaucgacaaguga

SEQ ID NO: 75945 - RNA, 1413 nt, Artificial Sequence; identical to SEQ ID NO: 75933
  derived and/or modified sequence opt1 from neuraminidase__InfluenzaA__ABD95199

SEQ ID NO: 75946 - RNA, 1413 nt, Artificial Sequence; identical to SEQ ID NO: 75423
  derived and/or modified sequence opt1 from neuraminidase__InfluenzaA__ABD95210

SEQ ID NO: 75947 - RNA, 1413 nt, Artificial Sequence
  derived and/or modified sequence opt1 from neuraminidase__InfluenzaA__ABD95221
augaaccccaaccagaagaucaucaccaucggcagcaucuccaucgccaucgggaugaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacucccacuacgaggagugcagcugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcgaggggagcugcaacccggugacggucgacggcgcgaacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccggcccugcuucuggguggagcugguccgcgggcucccgaaggagaacaccaccaucuggacguccggcagcuccaucagcuucugcggggugaacuccgacaccgccaacuggagcuggcccgacggcgccgagcugcccuucaccaucgacaaguga

SEQ ID NO: 75948 - RNA, 1413 nt, Artificial Sequence; identical to SEQ ID NO: 75938
  derived and/or modified sequence opt1 from neuraminidase__InfluenzaA__ABD95232

SEQ ID NO: 75949 - RNA, 1413 nt, Artificial Sequence; identical to SEQ ID NO: 75404
  derived and/or modified sequence opt1 from neuraminidase__InfluenzaA__ABD95243

SEQ ID NO: 75950 - RNA, 1413 nt, Artificial Sequence; identical to SEQ ID NO: 75938
  derived and/or modified sequence opt1 from neuraminidase__InfluenzaA__ABD95254

SEQ ID NO: 75951 - RNA, 1413 nt, Artificial Sequence; identical to SEQ ID NO: 75423
  derived and/or modified sequence opt1 from neuraminidase__InfluenzaA__ABD95265

SEQ ID NO: 75952 - RNA, 1413 nt, Artificial Sequence; identical to SEQ ID NO: 75404
  derived and/or modified sequence opt1 from neuraminidase__InfluenzaA__ABD95276

SEQ ID NO: 75953 - RNA, 1413 nt, Artificial Sequence
  derived and/or modified sequence opt1 from neuraminidase__InfluenzaA__ABD95287
augaaccccaaccagaagaucaucaccaucggcagcaucuccguggccaucgggaucaucagccugaugcuccagaucggcaacaucaucuccaucugggccagccacuccauccagaccgggagccagaaccacacgggcgucugcaaccagcgcaucaucaccuacgagaacuccaccugggugaaccacaccuacgugaacaucaacaacacgaacgucaucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcagauccugcgcacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcagcggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccggcccugcuucugggucgagcuggugcgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 75954 - RNA, 1413 nt, Artificial Sequence; identical to SEQ ID NO: 75404
  derived and/or modified sequence opt1 from neuraminidase__InfluenzaA__ABD95298

SEQ ID NO: 75955 - RNA, 1413 nt, Artificial Sequence
  derived and/or modified sequence opt1 from neuraminidase__InfluenzaA__ABD95309
augaaccccaaccagaagaucaucaccaucggcagcaucuccaucgccaucgggaugaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaagugcaaccggcugcgcaagggguucgagaugaucugggaccccaacggcuggaccgacaccgacuccgacuucagcgucaagcaggacgugguggccaucacggacugguccggguacagcggcagcuucguccagcaccccgagcucaccggccuggacugcauccggcccugcuucuggguggagcugguccgcgggcucccgaaggagaacaccaccaucuggacguccggcagcuccaucagcuucugcggggugaacuccgacaccgccaacuggagcuggcccgacggcgccgagcugcccuucaccaucgacaaguga

SEQ ID NO: 75956 - RNA, 1413 nt, Artificial Sequence; identical to SEQ ID NO: 75404
  derived and/or modified sequence opt1 from neuraminidase__InfluenzaA__ABD95320

SEQ ID NO: 75957 - RNA, 1413 nt, Artificial Sequence; identical to SEQ ID NO: 75933
  derived and/or modified sequence opt1 from neuraminidase__InfluenzaA__ABD95331

SEQ ID NO: 75958 - RNA, 1413 nt, Artificial Sequence
  derived and/or modified sequence opt1 from neuraminidase__InfluenzaA__ABD95342
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacagcucccugugcccggugcggggcugggccaucuacagcaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcgucgcguggagcgccuccgccugccacgacggcaugggcuggcugaccaucgggaucagcggccccgacgacggggccguggcggugcucaaguacaacggcaucaucacggagaccaucaaguccuggcgcaagcggauccugcgcacccaggagagcgagugcgucugcaucaacggcuccugcuucaccaucaugacggacgggcccagcaacggcccggccuccuaccggaucuucaagaucgagaaggggaagaucaccaagagcaucgagcuggacgcccccaacucccacuacgaggagugcagcugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugacggucgacggggccgacggcgugaagggcuucuccuaccgguacgggaacggcguguggaucgggcgcaccaagagcaacuccagccggaagggcuucgagaugaucugggaccccaacggguggaccgacaccgacuccaacuuccuggucaagcaggacgugguggccaugacggacuggagcggcuacagcggcuccuucguccagcacccggagcugaccgggcucgacugcaugcgccccugcuucuggguggagcugauccggggccgcccccgggagaagaccaccaucuggacgagcggguccagcaucuccuucugcggcgucaacagcgacaccgugaacugguccuggcccgacggcgcggagcugccguucaccaucgacaaguga

SEQ ID NO: 75959 - RNA, 1413 nt, Artificial Sequence
  derived and/or modified sequence opt1 from neuraminidase__InfluenzaA__ABD95353
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcagcugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggagcaaccgccccuggguguccuucaaccagaaccucgacuaccagaucggcuacaucugcagcggcgucuucggggacaacccgcggcccaaggacggcaagggguccugcgaccccgugaacguggacggcgccgacggggucaagggcuucagcuaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggagcggguacuccggcagcuucgugcagcacccggagcugacgggccucgacugcaugcggcccugcuucugggucgagcugauccgcgggcggccccgcgagaagaccaccaucuggaccuccggcagcuccaucagcuucugcggggugaacuccgacacggucaacuggagcuggcccgacggcgcggagcugccguucaccaucgacaaguga

SEQ ID NO: 75960 - RNA, 1413 nt, Artificial Sequence; identical to SEQ ID NO: 75836
  derived and/or modified sequence opt1 from neuraminidase__InfluenzaA__ABE11660

SEQ ID NO: 75961 - RNA, 1413 nt, Artificial Sequence
  derived and/or modified sequence opt1 from neuraminidase__InfluenzaA__ABE11671
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcagauccugcgcacccaggagagcgagugcgugugcgucaacggcuccugcuucaccaucaugacggacgggcccagcaacggcgccgccuccuacaagaucuucaagaucgagaaggggaaggugaacaagagcaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcagcggcguguucggggacaacccccggcccaaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccgacaccgacagcgacuucuccgugaagcaggacguggucgccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 75962 - RNA, 1413 nt, Artificial Sequence
  derived and/or modified sequence opt1 from neuraminidase__InfluenzaA__ABE11682
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75963 - RNA, 1413 nt, Artificial Sequence; identical to SEQ ID NO: 75404
  derived and/or modified sequence opt1 from neuraminidase__InfluenzaA__ABE11693

SEQ ID NO: 75964 - RNA, 1413 nt, Artificial Sequence; identical to SEQ ID NO: 75404
  derived and/or modified sequence opt1 from neuraminidase__InfluenzaA__ABE11704

SEQ ID NO: 75965 - RNA, 1413 nt, Artificial Sequence; identical to SEQ ID NO: 75404
  derived and/or modified sequence opt1 from neuraminidase__InfluenzaA__ABE11715

SEQ ID NO: 75966 - RNA, 1413 nt, Artificial Sequence; identical to SEQ ID NO: 75933
  derived and/or modified sequence opt1 from neuraminidase__InfluenzaA__ABE11726

SEQ ID NO: 75967 - RNA, 1413 nt, Artificial Sequence; identical to SEQ ID NO: 75938
  derived and/or modified sequence opt1 from neuraminidase__InfluenzaA__ABE11737

SEQ ID NO: 75968 - RNA, 1413 nt, Artificial Sequence; identical to SEQ ID NO: 75404
  derived and/or modified sequence opt1 from neuraminidase__InfluenzaA__ABE11815

SEQ ID NO: 75969 - RNA, 1413 nt, Artificial Sequence; identical to SEQ ID NO: 75933
  derived and/or modified sequence opt1 from neuraminidase__InfluenzaA__ABE11826

SEQ ID NO: 75970 - RNA, 1413 nt, Artificial Sequence; identical to SEQ ID NO: 75933
  derived and/or modified sequence opt1 from neuraminidase__InfluenzaA__ABE11837

SEQ ID NO: 75971 - RNA, 1413 nt, Artificial Sequence; identical to SEQ ID NO: 75933
  derived and/or modified sequence opt1 from neuraminidase__InfluenzaA__ABE11848

SEQ ID NO: 75972 - RNA, 1413 nt, Artificial Sequence; identical to SEQ ID NO: 75938
  derived and/or modified sequence opt1 from neuraminidase__InfluenzaA__ABE11859

SEQ ID NO: 75973 - RNA, 1413 nt, Artificial Sequence
  derived and/or modified sequence opt1 from neuraminidase__InfluenzaA__ABE11903
augaaccccaaccagaagaucaucaccaucggcagcaucuccauggccaucgggaucaucagccugauccuccagaucggcaacaucaucuccaucugggccagccacuccauccagaccgggagccagaacuacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcagauccuccgcacccaggagagcgagugcgucugcgugaacggcuccugcuucaccaucaugacggacgggcccagcaacggcgccgccuccuaccggaucuucaagaucgagaaggggcgcgugaccaagagcaucgagcuggacgccccgaacuaccacuacgaggagugcuccugcuaccccgacaccggcaccgucaugugcgugugccgggacaacuggcacgggagcaaccgccccuggguguccuucaaccagaaccuggacuaccagaucggcuacaucugcagcggcgucuucggggacaacccccggccgaaggacggcgagggguccugcaaccccgugacgguggacggcgcggacggggucaagggcuucagcuaccgcuacggcaacgggguguggaucggccggaccaaguccaaccgccuccggaagggguucgagaugaucugggaccccaacggcuggaccgacaccgacagcgacuucuccaugaagcaggacguggucgccaugacggacuggagcggguacuccggcagcuucgugcagcaccccgagcugaccggccuggacugcaugcgcccgugcuucuggguggagcucguccgggggcugccccgcgagaacaccaccaucuggacgagcggcuccagcaucuccuucugcggggugaacagcgagaccgccaacugguccuggcccgacggcgccgagcugcccuucaccaucgacaaguga

SEQ ID NO: 75974 - RNA, 1413 nt, Artificial Sequence
  derived and/or modified sequence opt1 from neuraminidase__InfluenzaA__ABE11925
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggaaggugaccaagagcaucgagcuggacgccccgaacuaccacuacgaggagugcuccugcuaccccgacaccggcaccgugaugugcgucugccgggacaacuggcacgggagcaaccgccccuggguguccuucaaccagaaccuggacuaccagaucggcuacaucugcagcggcguguucggggacaacccccggccgaaggacggcgagggguccugcaaccccgucacggcggacggcgccgacggggugaagggcuucagcuaccgcuacggcaacgggguguggaucggccggaccaaguccaaccgccuccggaagggguucgagaugaucugggaccccaacggcuggaccgacaccgacagcgacuucuccaugaagcaggacaucgucgccaugacggacuggagcggguacuccggcagcuucgugcagcaccccgagcugaccggccuggacugcaugcgcccgugcuucuggguggagcucguccgggggcugccccgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75975 - RNA, 1413 nt, Artificial Sequence
  derived and/or modified sequence opt1 from neuraminidase__InfluenzaA__ABE11952
augaaccccaaccagaagaucaucaccaucggcagcaucuccauggccaucgggaucaucagccugauccuccagaucggcaacaucaucuccaucugggccagccacuccauccagaccgggagccagaacuacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcagauccuccgcacccaggagagcgagugcgucugcgugaacggcuccugcuucaccaucaugacggacgggcccagcaacggcgccgccuccuaccggaucuucaagaucgagaaggggcgcgugaccaagagcaucgagcuggacgccccgaacuaccacuacgaggagugcuccugcuaccccgacaccggcaccgucaugugcgugugccgggacaacuggcacgggagcaaccgccccuggguguccuucaaccagaaccuggacuaccagaucggcuacaucugcagcggcgucuucggggacaacccccggccgaaggacggcgagggguccugcaaccccgugacgguggacggcgcggacggggucaagggcuucagcuaccgcuacggcaacgggguguggaucggccggaccaaguccaaccgccuccggaagggguucgagaugaucugggaccccaacggcuggaccgacaccgacagcgacuucuccaugaagcaggacguggucgccaugacggacuggagcggguacuccggcagcuucgugcagcaccccgagcugaccggccuggacugcaugcgcccgugcuucuggguggagcucguccgggggcugccccgcgagaacaccaccaucuggacgagcggcuccagcaucuccuucugcggggugaacagcgagaccgccgacugguccuggcccgacggcgccgagcugcccuucaccaucgacaaguga

SEQ ID NO: 75976 - RNA, 1413 nt, Artificial Sequence
  derived and/or modified sequence opt1 from neuraminidase__InfluenzaA__ABE12035
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccgacaccggcaccgugaugugcgucugccgcgacaacuggcacgggagcaaccggcccuggguguccuucaaccagaaccuggacuaccagaucggcuacaucugcagcggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagaugaucugggaccccaacggcuggaccgacaccgacagcgacuucuccaugaagcaggacaucguggccaugacggacuggagcggguacuccggcagcuucgugcagcaccccgagcugaccggccuggacugcaugcggccgugcuucugggucgagcucgugcgcgggcugccccgggagaacaccaccaucuggacgagcggcuccagcaucuccuucugcggggugaacagcgacaccgccaacugguccuggcccgacggcgccgagcugcccuucaccaucgacaaguga

SEQ ID NO: 75977 - RNA, 1410 nt, Artificial Sequence; identical to SEQ ID NO: 75738
  derived and/or modified sequence opt1 from neuraminidase__InfluenzaA__ABE12094

SEQ ID NO: 75978 - RNA, 1410 nt, Artificial Sequence; identical to SEQ ID NO: 75870
  derived and/or modified sequence opt1 from neuraminidase__InfluenzaA__ABE12126

SEQ ID NO: 75979 - RNA, 1413 nt, Artificial Sequence; identical to SEQ ID NO: 75404
  derived and/or modified sequence opt1 from neuraminidase__InfluenzaA__ABE12263

SEQ ID NO: 75980 - RNA, 1410 nt, Artificial Sequence
  derived and/or modified sequence opt1 from neuraminidase__InfluenzaA__ABE12626
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaagugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggugugcaucgccugguccagcuccagcugccacgacggcaaggcguggcuccacgucugcgugaccggggacgacaagaacgccacggccuccuucaucuacgacggccggcugguggacagcaucggguccuggagccagaacauccugcgcacccaggaguccgagugcgucugcaucaacgggaccugcaccguggugaugacggacggcagcgccuccggccgggcggacacccgcauccucuucaucgaggagggcaagaucguccacaucagcccccugagcggguccgcccagcacguggaggagugcagcugcuacccccgguacccgggcgugcgcugcaucugccgggacaacuggaagggcuccaaccgccccgucguggacaucaacgugaaggacuacagcaucgacuccagcuacgucugcuccgggcuggugggcgacacgccccggaacaacgaccgcagcuccaacagcuacugccggaaccccaacaacgagcgcgggaaccacggcgugaaggggugggccuucgacgacggcaacgacgucuggaugggccggaccaucuccaaggacagccgcuccggguacgagaccuucaaggugaucggcggguggagcaccccgaacuccaagagccagaucaaccggcaggucaucguggacuccgacaaccgcagcggcuacuccgggaucuucagcguggagggcaagagcugcaucaaccgcugcuucuacgucgagcucauccggggccgcgagcaggagacccgggugugguggaccuccaacagcaucguggucuucugcgggacguccggcaccuacgggaccggcagcuggcccgacggggccgacaucaaccugaugcccaucuga

SEQ ID NO: 75981 - RNA, 1410 nt, Artificial Sequence
  derived and/or modified sequence opt1 from neuraminidase__InfluenzaA__ABE12650
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucaaggaggggaagaucguccacaucagcccccugcucggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcuccgcuccggguacgagaccuucaaggucaucgagggcuggagcaagccgaacuccaagcugcagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggggccgacaucaaccucaugcccaucuga

SEQ ID NO: 75982 - RNA, 1410 nt, Artificial Sequence
  derived and/or modified sequence opt1 from neuraminidase__InfluenzaA__ABE13095
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagcccccugagcggguccgcgcagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacgggagcuccagcuccuacugccuggaccccaacaacgaggagggcgggcacggcgucaagggcugggccuucgacgacgggaacgacguguggaugggccggaccaucagcgagaagcugcgcuccggguacgagaccuucaaggucaucggcggguggagcaagccgaacuccaagcuccagaucaaccgccaggugaucguggacaagggcaaccggagcggcuacuccgggaucuucagcgucgagggcaaguccugcaucaaccggugcuucuacguggagcugauccgcgggcggaagcaggagaccgaggugugguggacgagcaacagcaucgucguguucugcggcaccuccgggaccuacggcaccggcagcuggcccgacggggccgacaucaaccugaugcccaucuga

SEQ ID NO: 75983 - RNA, 1410 nt, Artificial Sequence; identical to SEQ ID NO: 75134
  derived and/or modified sequence opt1 from neuraminidase__InfluenzaA__ABE13332

SEQ ID NO: 75984 - RNA, 1410 nt, Artificial Sequence; identical to SEQ ID NO: 75134
  derived and/or modified sequence opt1 from neuraminidase__InfluenzaA__ABE13558

SEQ ID NO: 75985 - RNA, 1410 nt, Artificial Sequence
  derived and/or modified sequence opt1 from neuraminidase__InfluenzaA__ABE13642
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgagcggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacaacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccugaaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccugaugcccaucuga

SEQ ID NO: 75986 - RNA, 1410 nt, Artificial Sequence
  derived and/or modified sequence opt1 from neuraminidase__InfluenzaA__ABE13668
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccugaaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccugaugcccaucuga

SEQ ID NO: 75987 - RNA, 1410 nt, Artificial Sequence
  derived and/or modified sequence opt1 from neuraminidase__InfluenzaA__ABE13836
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccggcaagugcuaccaguucgcccuggggcagggcaccacgcucaacaaccgccacagcaacgacaccguccacgaccggacccccuaccgcacccugcugaugaacgagcucggcgugccguuccaccuggggacgaagcaggucugcaucgccugguccagcuccagcugccacgacggcaaggcguggcugcacgugugcgugaccgggcacgacgagaacgccaccgccuccuucaucuacgacggccggcucguggacagcaucggguccuggagcaagaacauccugcgcacccaggaguccgagugcgucugcaucaacggcacgugcaccguggugaugaccgacggcagcgccuccgggcgggcggacaccaagauccuguucaucgaggagggcaagaucguccacaucagcccccucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccugaaccccaacaacgaggagggcgggcacggggucaagggcugggccuucgacgacggcaacgacguguggauggggcggaccaucuccgagaagcuccgcagcggcuacgagaccuucaaggucaucgggggcugguccaagcccaacagcaagcugcagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggccggacggcgccgacaucaaccucaugcccaucuga

SEQ ID NO: 75988 - RNA, 1410 nt, Artificial Sequence
  derived and/or modified sequence opt1 from neuraminidase__InfluenzaA__ABE14033
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccugaaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccugaugcccaucuga

SEQ ID NO: 75989 - RNA, 1410 nt, Artificial Sequence
  derived and/or modified sequence opt1 from neuraminidase__InfluenzaA__ABE14055
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucuccagcugguccaagaacauccuccgcacccaggagagcgagugcgucugcaucaacggcacgugcaccguggugaugaccgacggguccagcagcggccgggccgacaccaagauccuguucaucgaggagggcaagaucguccacaucagcccccuguccggguccgcgcagcacguggaggagugcagcugcuacccccgcuacccgggcgugcggugcgucugccgcgacaacuggaagggguccaaccggcccaucguggacaucaacgugaaggacuacagcaucgucuccagcuacgugugcuccggccucgugggcgacacgccccgcaagaacgacagcuccagcuccagcuacugccugaaccccaacaacgaggagggcgggcacggggucaagggcugggccuucgacgacgggaacgacguguggaugggccggaccaucuccgagaagcugcgcagcggcuacgagaccuucaaggucaucgggggcugguccaagccgaacagcaagcuccagaucaaccgccaggugaucguggaccgggggaaccgguccggcuacagcgggaucuucagcgucgagggcaaguccugcgugaaccgcugcuucuacguggagcugauccggggccgcaagcaggagaccgaggucugguggacgagcaacuccaucgugguguucugcgggaccagcggcaccuacgggaccggcuccuggcccgacggggccgacaucaaccugaugcccaucuga

SEQ ID NO: 75990 - RNA, 1410 nt, Artificial Sequence
  derived and/or modified sequence opt1 from neuraminidase__InfluenzaA__ABE14857
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaccaccgagaucgucuaccugaccaacacgaccaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcacgacccugaacaaccgccacagcaacgacaccguccacgaccggaccccguaccgcacgcuccugaugaacgagcugggcgugcccuuccaccucgggaccaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacgcaggaguccgagugcgucugcaucaacgggaccugcaccguggugaugaccgacggcagcgccuccgggcgggcggacacgaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccugaaccccaacaacgaggagggcggccacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggaccagcaacuccaucgucguguucugcgggaccagcggcaccuacgggacgggcuccuggcccgacggcgccgacaucaaccugaugcccaucuga

SEQ ID NO: 75991 - RNA, 1410 nt, Artificial Sequence; identical to SEQ ID NO: 75988
  derived and/or modified sequence opt1 from neuraminidase__InfluenzaA__ABE15594

SEQ ID NO: 75992 - RNA, 1413 nt, Artificial Sequence
  derived and/or modified sequence opt1 from neuraminidase__InfluenzaA__ABE26994
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccgacaccggcaccgugaugugcgucugccgcgacaacuggcacagcuccaaccggcccugggugagcuucaaccagaaccuggacuaccagaucggguacaucugcuccggcguguucggcgacaacccccgcccgaaggacggggagggcagcugcaaccccgucacgguggacggggcggacggcgugaagggguucuccuaccgguacggcaacggcgucuggaucgggcgcaccaagagcaaccggcuccgcaagggcuucgagaugaucugggaccccaacggguggaccgacaccgacuccgacuucagcaugaagcaggacaucguggccaugacggacugguccggcuacagcgggagcuucgugcagcaccccgagcugaccggccuggacugcaugcggccgugcuucugggucgagcucgugcgcggccugccccgggagaacaccaccaucuggacguccgggagcuccaucagcuucugcggcgugaacuccgacaccgccaacuggagcuggcccgacggggccgagcugcccuucaccaucgacaaguga

SEQ ID NO: 75993 - RNA, 1350 nt, Artificial Sequence
  derived and/or modified sequence opt1 from neuraminidase__InfluenzaA__ABE97641
augaaccccaaccagaagaucaucaccaucggcagcaucugcauggugaucgggaucaucucccugaugcuccagaucggcaacaugaucagcaucugggucucccacagcauccagaccuggaaccagcaccaggccgaguccaucagcaacacgaacccgcugaccgagaaggccguggcguccgugacccuggccgggaacagcucccucugccccauccgcggcugggccguccacagcaaggacaacuccauccggaucgggagcaagggcgacguguucgugauccgcgagcccuucaucuccugcagccaccuggagugccggaccuucuuccugacgcagggcgcccuccugaacgacaagcacuccaacgggaccgucaaggaccgcagcccccaccggacccugauguccugcccggugggcgaggcccccagccccuacaacucccgcuucgagagcguggcguggagcgccuccgccugccacgacgggaccagcuggcucacgaucggcaucuccgggcccgacaacggcgccgucgcggugcugaaguacaacggcaucaucaccgacaccaucaagagcuggcggaacaacauccugcgcacccaggaguccgagugcgccugcgugaacgggagcugcuucacggucaugaccgacggcccguccaacgggcaggccagcuacaagaucuucaagauggagaagggcaagguggugaaguccgucgagcucgacgcccccaacuaccacuacgaggagugcagcugcuaccccgacgccggcgagaucacgugcgugugccgggacaacuggcacggguccaaccgccccuggaucagcuucaaccagaaccuggaguaccagaucggcuacaucugcuccgggguguucggcgacaacccgcggcccaacgacgggaccggcagcugcggccccaugucccccaacggggcguacggcgucaagggguucagcuucaaguacggcaacgggguguggaucggccgcaccaaguccaccaacagccgguccggcuucgagaugaucugggacccgaacggguggaucggcaccgacagcagcuucuccgugaagcaggacaucgucgccaucaccgacuggagcggguacuccggcagcuucgugcagcaccccgagcugacggggcucgacugcauccgccccugcuucuggguggagcugauccggggccgccccaaggaguccaccaucuggaccagcggcuccagcaucuccuucugcggggucaacagcgacaucguguccuggagcuggccggacggcgccgagcugcccuucaccaucgacaaguga

SEQ ID NO: 75994 - RNA, 1350 nt, Artificial Sequence
  derived and/or modified sequence opt1 from neuraminidase__InfluenzaA__ABE97642
augaaccccaaccagaagaucaucaccaucggcagcaucugcauggugaucgggauggucucccugaugcuccagaucggcaacaugaucagcaucuggcugucccacagcauccagaccgggaaccagcaccaggccgaguccaucagcaacaacaaccugcucacggagaacgccguggcguccgugacccuggccggcaacagcucccugugcccgauccgcgggugggccguccacagcaaggacaacuccauccggaucggcagcaagggcgacguguucgugauccgcgagcccuucaucuccugcagccaccucgagugccggaccuucuuccugacccagggggcccugcucaacgacaagcacuccaacggcacggucaaggaccgcagcccccaccggacccugauguccugccccgugggggaggccccgagccccuacaacucccgcuucgagagcguggcguggagcgccuccgccugccacgacggcaucagcuggcugaccaucgggaucuccggccccgacaacggcgccgucgcggugcucaaguacaacgggaucaucaccgacacgaucaagagcuggcggaacaacauccugcgcacccaggaguccgagugcgccugcgugaacggcagcugcuucaccgucaugaccgacgggcccuccaacggccaggccagcuacaagaucuucaagauggagaagggcaagguggugaaguccgucgagcuggacgccccgaacuaccacuacgaggagugcagcugcuaccccgacgccggggagaucacgugcgugugccgggacaacuggcacggcuccaaccgccccugggugagcuucaaccagaaccucgaguaccagaucggguacaucugcuccggcgucuucggggacaacccccggccgaacgacggcaccggcagcugcgggcccaugucccccaacggcgcguacggggugaagggcuucagcuucaaguacgggaacggcguguggaucggccgcaccaaguccaccaacagccgguccggguucgagaugaucugggaccccaacggcuggacggggaccgacagcagcuucuccgucaagcaggacaucguggccaucaccgacuggagcggcuacuccgggagcuucgugcagcacccggagcugaccggccuggacugcauccgccccugcuucugggucgagcucauccggggccgccccaaggaguccacgaucuggaccagcggguccagcaucuccuucugcggcgugaacggggacaccgucagcugguccuggcccgacggcgccgagcugccguucaucaucgacaaguga

SEQ ID NO: 75995 - RNA, 1350 nt, Artificial Sequence
  derived and/or modified sequence opt1 from neuraminidase__InfluenzaA__ABE97644
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacggcgccguggcggugcugaaguacaacgggaucaucaccgacaccaucaaguccuggcggaacaacauccugcgcacccaggagagcgagugcgccugcgucaacggcuccugcuucacggugaugaccgacgggccgagcaacggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccaugagccccaacggcgcguacggggugaagggcuucuccuucaaguacgggaacggcgucuggaucggccgcaccaagagcaccaacucccggagcggguucgagaugaucugggacccgaacggcuggaccgggaccgacuccagcuucagcgugaagcaggacaucguggcccugacggacugguccggcuacagcggguccuucguccagcaccccgagcucaccggccuggacugcauccgccccugcuucuggguggagcugauccggggccgccccaaggagagcaccaucuggaccuccgggagcuccaucagcuucugcggcgucaacuccgacacggugagcugguccuggccggacggggccgagcuccccuucaccaucgacaaguga

SEQ ID NO: 75996 - RNA, 1350 nt, Artificial Sequence
  derived and/or modified sequence opt1 from neuraminidase__InfluenzaA__ABE97645
augaaccccaaccagaagaucaucaccaucggcagcaucugcauggugaucgggaccgucucccugaugcuccagaucggcaacaugaucagcaucugggugucccacagcauccagacggggaaccagcaccaggccgagccgaccuccagcaccaacccccugaccgagaaggccguggcguccgucacgcuggccggcaacagcucccucugccccauccgcgggugggccauccacagcaaggacaacuccauccggaucggcagcaagggcgacguguucgugauccgcgagcccuucaucuccugcagccaccuggagugccggaccuucuuccugacccagggggcccuccugaacgacaagcacuccaacggcaccgucaaggaccgcagcccgcaccggacgcugauguccugccccgugggggaggcccccagccccuacaacucccgcuucgagagcguggcguggagcgccuccgccugccacgacggcaccagcuggcucaccaucgggaucuccggcccggacaacggcgccgucgcggugcugaaguacaacgggaucaucaccgacacgaucaagagcuggcggaacaacauccugcgcacccaggaguccgagugcgccugcgugaacggcagcugcuucaccgucaugaccgacgggcccuccaacggccaggccagcuacaagaucuucaagauggagaagggcaagguggugaaguccgucgagcucgacgcccccaacuaccacuacgaggagugcagcugcuaccccgacgccggggagaucacgugcgugugccgggacaacuggcacggcuccaaccgcccgugggugagcuucaaccagaaccuggaguaccagaucggguacaucugcuccggcgucuucggggacaacccccggcccaacgacggcaccggcagcugcgggcccauguccccgaacggcgcguacggggugaagggcuucgccuucaaguacgggaacggcguguggaucggccgcaccaagagcaccaacucccggagcggguucgagaugaucugggaccccaacggcuggacggggcccgacuccagcuucagcgucaagcaggacaucguggccaucaccgacugguccggcuacagcggguccuucgugcagcaccccgagcugaccggccucgacugcauccgcccgugcuucugggucgagcugauccggggccgccccaaggagagcaccaucuggacguccgggagcuccaucagcuucugcggcgugaacuccgacaccgucagcugguccuggcccgacggggccgagcugcccuucaccaucgacaaguga

SEQ ID NO: 75997 - RNA, 1350 nt, Artificial Sequence
  derived and/or modified sequence opt1 from neuraminidase__InfluenzaA__ABE97646
augaaccccaaccagaagaucaucaccaucggcagcaucugcauggugaucgggaucgucucccugaugcuccagaucggcaacaugaucagcaucugggugucccacagcauccagaccgagaaccagcaccaggccgaguccaucagcaacacgaacccgcccaccgagaaggccguggcguccgucacccuggccgggaacagcucccugugccccauccgcggcugggccgugcacagcaaggacaacuccauccggaucgggagcaagggcgacguguucgucauccgcgagcccuucaucuccugcagccaccucgagugccggaccuucuuccugacgcagggcgcccugcucaacgacaagcacuccaacgggaccgugaaggaccgcagcccgcaccggacccugauguccugccccgugggcgaggcccccagccccuacaacucccgcuucgagagcgucgcguggagcgccuccgccugccacgacgggaccagcuggcugacgaucggcaucuccgggccggacaacggcgccguggcggugcucaaguacaacggcaucaucaccgacaccaucaagagcuggcggaacaacacccugcgcacgcaggaguccgagugcgccugcgucaacgggagcugcuucaccgugaugaccgacggccccuccaacgggcaggccagcuacaagaucuucaagauggagaagggcaagguggucaaguccguggagcuggacgcccccaacuaccacuacgaggagugcagcugcuaccccgacgccggcgagaucacgugcgugugccgggacaacuggcacggguccaaccgcccgugggucagcuucaaccagaaccucgaguaccagaucggcuacaucugcuccgggguguucggcgacaacccccggcccaacgacgggaccggcagcugcggccccauguccccgaacggggcguacggcgugaagggguucagcuucaaguacggcaacggggucuggaucggccgcaccaaguccaccaacagccgguccggcuucgagaugaucugggaccccaacggguggaccggcacggacagcagcuucuccgugaagcaggacaucgugagcaucaccgacugguccggguacagcggcuccuucguccagcaccccgagcugaccgggcuggacugcauccgccccugcuucuggguggagcucauccggggccgcccgaaggagagcaccaucuggacguccggcagcuccaucagcuucugcggggucaacuccgacaccgugagcugguccuggcccgacggcgccgagcugcccuucaccaucgacaaguga

SEQ ID NO: 75998 - RNA, 1350 nt, Artificial Sequence
  derived and/or modified sequence opt1 from neuraminidase__InfluenzaA__ABE97647
augaaccccaaccagaagaucaucaccaucggcagcaucugcauggugaucgggaucgucucccugaugcuccagaucggcaacaugaucagcaucugggugucccacagcauccagaccgggaaccagcaccgcgccgaguccaucagcaacacgaacccgcugaccgagaaggccguggcguccgucacccuggccggcaacagcucccucugccccauccgggggugggccgugcacagcaaggacaacaacauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggccgagcaacggccaggccuccuacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccaugagccccaacggcgcguacggggugaagggcuucuccuucaaguacgggaacggcgucuggaucggccggaccaagagcaccaacucccgcagcggguucgagaugaucugggacccgaacggcuggaccgggaccgacuccagcuucagcgugaagcaggacaucguggccaucacggacugguccggcuacagcggguccuucguccagcaccccgagcugaccggccucgacugcauccggcccugcuucuggguggagcugauccgcggccggcccaaggagagcaccaucuggaccuccgggagcuccaucagcuucugcggcgucaacuccgacacggugagcugguccuggccggacggggccgagcugcccuucaccaucgacaaguga

SEQ ID NO: 75999 - RNA, 1350 nt, Artificial Sequence
  derived and/or modified sequence opt1 from neuraminidase__InfluenzaA__ABE97649
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacuccauccggaucggcagcaagggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccaacggccaggccagcuacaagaucuucaagauggagaagggcaagguggucaaguccguggagcucgacgcccccaacuaccacuacgaggagugcagcugcuaccccgacgccggggagaucacgugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccaugucccccaacggcgcguacggggugaagggcuucagcuucaaguacgggaacggcgucuggaucggccgcaccaaguccaccaacagccgguccggguucgagaugaucugggacccgaacggcuggaccgggaccgacagcagcuucuccgugaagcaggacaucguggccaucacggacuggagcggcuacuccgggagcuucguccagcaccccgagcugaccggccucgacugcauccgccccugcuucuggguggagcugauccggggccgccccaaggaguccaccaucuggaccagcggguccagcaucuccuucugcggcgucaacagcgacacgguguccuggagcuggccggacggggccgagcugcccuucaccaucgacaaguga

SEQ ID NO: 76000 - RNA, 1350 nt, Artificial Sequence; identical to SEQ ID NO: 75999
  derived and/or modified sequence opt1 from neuraminidase__InfluenzaA__ABE97651

SEQ ID NO: 76001 - RNA, 1350 nt, Artificial Sequence; identical to SEQ ID NO: 75999
  derived and/or modified sequence opt1 from neuraminidase__InfluenzaA__ABE97653

SEQ ID NO: 76002 - RNA, 1350 nt, Artificial Sequence; identical to SEQ ID NO: 75999
  derived and/or modified sequence opt1 from neuraminidase__InfluenzaA__ABE97654

SEQ ID NO: 76003 - RNA, 1350 nt, Artificial Sequence
  derived and/or modified sequence opt1 from neuraminidase__InfluenzaA__ABE97655
augaaccccaaccagaagaucaucaccaucggcagcaucugcauggccaucgggaucgugucccugaugcuccagaucggcaacaugaucagcaucugggucucccacagcauccagaccgggaaccagcaccaggccgaguccacgagcaacaccaacccgcugaccgagaaggcgguggccuccgugacccuggccggcaacagcucccucugccccauccgcgggugggccauccacagcaaggacaacuccauccggaucggcagcaagggcgacgucuucgugauccgcgagcccuucaucuccugcagccaccuggagugccggacguucuuccugacccagggggcccuccugaacgacaagcacuccaacggcaccgugaaggaccgcagcccccaccggacccugauguccugcccggucggggaggcgcccagccccuacaacucccgcuucgagagcguggccuggagcgccuccgccugccacgacggcacgagcuggcucaccaucgggaucuccggccccgacaacggcgcgguggccguccugaaguacaacgggaucaucaccgacaccaucaagagcuggcggaacaacauccugcgcacgcaggaguccgagugcgccugcgugaacggcagcugcuucaccgugaugaccgacgggccguccaacggccaggccagcuacaagaucuucaagauggagaagggcaaggucgugaaguccguggagcucgacgcccccaacuaccacuacgaggagugcagcugcuaccccgacgcgggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccaugucccccaacggcgccuacggggucaagggcuucgccuucaaguacgggaacggcguguggaucggccgcaccaagagcaccaacucccggagcggguucgagaugaucugggacccgaacggcuggaccgggcccgacuccagcuucagcgugaagcaggacaucgucgccaucacggacugguccggcuacagcggguccuucgugcagcaccccgagcugaccggccucgacugcauccgccccugcuucuggguggagcugauccggggccgcccgaaggagagcaccaucuggaccuccgggagcuccaucagcuucugcggcgucaacuccgacacggugagcugguccuggcccgacggggccgagcugcccuucaccaucgacaaguga

SEQ ID NO: 76004 - RNA, 1350 nt, Artificial Sequence
  derived and/or modified sequence opt1 from neuraminidase__InfluenzaA__ABE97657
augaaccccaaccagaagaucaucaccaucggcagcaucugcauggugaucgggaccgucucccuggugcuccagaucggcaacaugaucagcaucugggugucccacagcauccagacggggaaccagcaccaggccgaguccaucagcaacaccaacccgcugaccgagaaggccgucgcguccgugacccuggccggcaacagcucccucugccccauccgcgggugggccgugcacagcaaggacaacuccauccggaucggcagcaagggcgacgucuucgugauccgcgagcccuucaucuccugcagccaccuggagugccggacguucuuccugacccagggggcccuccugaacgacaagcacuccaacggcaccgugaaggaccgcagcccccaccggacccugauguccugcccggucggggaggcccccagccccuacaacucccgcuucgagagcguggcguggagcgccuccgccugccacgacggcacgagcuggcucaccaucgggaucuccggccccgacaacggcgccguggcgguccugaaguacaacgggaucaucaccgacaccaucaagagcuggcgggacaacauccugcgcacgcaggaguccgagugcgccugcgugaacggcagcugcuucaccgugaugaccgacgggccguccaacggccaggccagcuacaagaucuucaagauggagaagggcaaggucgugaaguccguggagcucgacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccauguccagcaacggcgcguacggggucaagggcuucuccuucaaguacgggaacggcguguggaucggccgcaccaagagcaccaacucccggagcggguucgagaugaucugggaccccaacggcuggaccgggacggacagcuccuucagcgugaagcaggacaucgucgccaucaccgacugguccggcuacagcggguccuucgugcagcacccggagcugaccggccucgacugcauccgccccugcuucugggucgagcugauccggggccgccccaaggagagcaccaucuggacguccgggagcuccaucagcuucugcggcgugaacuccgacaccgugagcugguccuggcccgacggggccgagcugccguucaccaucgacaaguga

SEQ ID NO: 76005 - RNA, 1350 nt, Artificial Sequence
  derived and/or modified sequence opt1 from neuraminidase__InfluenzaA__ABE97658
augaaccccaaccagaagaucaucaccaucggcagcaucugcauggugaucgggaccaucucccugaugcuccagaucggcaacaugaucagcaucugggucucccacagcauccagacggggaaccagcaccagaccgaguccaucagcaacaccaacccgcugaccgagaaggccguggccuccgugacgcuggcgggcaacagcucccucugcagcauccgcgggugggccguccacuccaaggacaacagcauccggaucggcuccaagggcgacguguucgugauccgcgagcccuucaucagcugcucccaccuggagugccggaccuucuuccugacccagggggcccuccugaacgacaagcacagcaacggcaccgucaaggaccgcagcccccaccggacgcugaugagcugccccgugggggaggccccgucccccuacaacagccgcuucgagagcguggccugguccgcgagcgccugccacgacggcaccuccuggcucaccaucgggaucagcggccccgacaacggcgccgucgccgugcugaaguacaacgggaucaucaccgacacgaucaaguccuggcgggacaacauccugcgcacccaggagagcgagugcgcgugcgugaacggcuccugcuucaccgucaugaccgacgggcccagcaacggccaggccuccuacaagaucuucaagauggagaagggcaagguggugaaguccgucgagcucgacgccccgaacuaccacuacgaggagugcuccugcuaccccgacgccggggagaucacgugcgugugccgggacaacuggcacggcagcaaccgccccuggguguccuucaaccagaaccuggaguaccagaucggguacaucugcagcggcgucuucggggacaacccccggccgaacgacggcaccggcuccugcgggcccaugagcuccaacggcgcccacggggugaagggcuucagcuucaaguacgggaacggcguguggaucggccgcaccaaguccaccaacagccggagcggguucgagaugaucugggaccccaacggcuggacggggaccgacuccagcuucuccgucaagcaggacaucguggcgaucaccgacuggagcggcuacuccgggagcuucgugcagcaccccgagcugaccggccucgacugcauccgcccgugcuucugggucgagcugauccggggccgccccaaggaguccacgaucuggaccagcggguccagcaucuccuucugcggcgugaacagcgacaccgucuccuggagcuggcccgacggggccgagcugcccuucaccaucgacaaguga

SEQ ID NO: 76006 - RNA, 1350 nt, Artificial Sequence
  derived and/or modified sequence opt1 from neuraminidase__InfluenzaA__ABE97659
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacuccauccggaucggcagcaagggcgacguguucgucauccgcgagcccuucaucuccugcagccaccuggagugccggaccuucuuccugacgcagggggcccuccugaacgacaagcacuccaacgagaccgugaaggaccgcagcccccaccggacccugauguccugcccggugggcgaggcccccagccccuacaacucccgcuucgagagcgucgcguggagcgccuccgccugccacgacgggaccagcuggcucacgaucggcaucuccgggcccgacaacggcgccguggcggugcugaaguacaacggcaucaucaccgacaccaucaagagcuggcgggacaacauccugcgcacccaggaguccgagugcgccugcgucaacgggagcugcuucacggugaugaccgacggcccguccaacgggcaggccagcuacaagaucuucaagauggagaagggcaagguggucaaguccguggagcucgacgcccccaacuaccacuacgaggagugcagcugcuaccccgacgccggcgagaucacgugcgugugccgggacaacuggcacggguccaaccgccccugggucagcuucaaccagaaccuggaguaccagaucggcuacaucugcuccgggguguucggcgacaacccgcggcccaacgacgggaccggcagcugcggccccauguccagcaacggggcguacggcgugaagggguucuccuucaaguacggcaacggggucuggaucggccgcaccaagagcaccaacucccggagcggcuucgagaugaucugggaccccaacggguggaccggcaccgacagcuccuucagcgugaagcaggacaucguggccaucacggacugguccggguacagcggcuccuucguccagcacccggagcugaccgggcucgacugcauccgccccugcuucuggguggagcugauccggggccgccccaaggagagcaccaucuggaccuccggcagcuccaucagcuucugcggggucaacuccgacacggugagcugguccuggcccgacggcgccgagcugccguucaccaucgacaaguga

SEQ ID NO: 76007 - RNA, 1350 nt, Artificial Sequence
  derived and/or modified sequence opt1 from neuraminidase__InfluenzaA__ABE97660
augaaccccaaccagaagaucaucaccaucggcagcaucugcauggugaucgggaccaucucccugaugcuccagaucggcaacaugaucagcaucugggucucccacagcauccagacggggaaccagcaccaggccgaguccaucagcaacaccaacccgcugaccgagaaggccguggcguccgugacccuggccggcaacagcucccucugccccauccgcgggugggccguccacagcaaggacaacuccauccggaucggcagcaagggcgacguguucgugauccgcgagcccuucaucuccugcagccaccuggagugccggacguucuuccugacccagggggcccuccugaacgacaagcacuccaacggcaccgucaaggaccgcagcccccaccggacccugauguccugcccggugggggaggcccccagccccuacaacucccgcuucgagagcguggcguggagcgccuccgccugccacgacggcacgagcuggcucaccaucgggaucuccggccccgacaacggcgccgucgcggugcugaaguacaacgggaucaucaccgacaccaucaagagcuggcgggacaacauccugcgcacgcaggaguccgagugcgccugcgugaacggcagcugcuucaccgucaugaccgacgggccguccaacggccaggccagcuacaagaucuucaagauggagaagggcaagguggugaaguccgucgagcucgacgcccccaacuaccacuacgaggagugcagcugcuaccccgacgccggggagaucacgugcgugugccgggacaacuggcacggcuccaaccgccccugggugagcuucaaccagaaccuggaguaccagaucggguacaucugcuccggcgucuucggggacaacccgcggcccaacgacggcaccggcagcugcgggcccauguccagcaacggcgcgcacggggugaagggcuucuccuucaaguacgggaacggcguguggaucggccgcaccaagagcaccaacucccggagcggguucgagaugaucugggaccccaacggcuggaccgggacggacagcuccuucagcgucaagcaggacaucguggccaucaccgacugguccggcuacagcggguccuucgugcagcacccggagcugaccggccucgacugcauccgccccugcuucugggucgagcugauccggggccgccccaaggagagcaccaucuggacguccgggagcuccaucagcuucugcggcgugaacuccgacaccgucagcugguccuggcccgacggggccgagcugccguucaccaucgacaaguga

SEQ ID NO: 76008 - RNA, 1350 nt, Artificial Sequence
  derived and/or modified sequence opt1 from neuraminidase__InfluenzaA__ABE97661
augaaccccaaccagaagaucaucaccaucggcagcaucugcauggugaucgggaccaucucccugaugcuccagaucggcaacaugaucagcaucugggucucccacagcauccagacggggaaccagcaccagaccgaguccaucagcaacaccaacccgcugaccgagaaggccguggccuccgugacgcuggcgggcaacagcucccucugccccauccgcgggugggccguccacagcaaggacaacuccauccggaucggcagcaagggcgacguguucgugauccgcgagcccuucaucuccugcagccaccuggagugccggaccuucuuccugacccagggggcccuccugaacgacaagcacuccaacggcaccgucaaggaccgcagcccccaccggacgcugauguccugcccggugggggaggcccccagccccuacaacucccgcuucgagagcguggccuggagcgcguccgccugccacgacggcaccagcuggcucaccaucgggaucuccggccccgacaacggcgccgucgccgugcugaaguacaacgggaucaucaccgacacgaucaagagcuggcgggacaacauccugcgcacccaggaguccgagugcgcgugcgugaacggcagcugcuucaccgucaugaccgacgggccguccaacggccaggccagcuacaagaucuucaagauggagaagggcaagguggugaaguccgucgagcucgacgcccccaacuaccacuacgaggagugcagcugcuaccccgacgccggggagaucacgugcgugugccgggacaacuggcacggcuccaaccgccccugggugagcuucaaccagaaccuggaguaccagaucggguacaucugcuccggcgucuucggggacaacccgcggcccaacgacggcaccggcagcugcgggcccauguccagcaacggcgcccacggggugaagggcuucuccuucaaguacgggaacggcguguggaucggccgcaccaagagcaccaacucccggagcggguucgagaugaucugggaccccaacggcuggacggggaccgacagcuccuucagcgucaagcaggacaucguggcgaccaccgacugguccggcuacagcggguccuucgugcagcacccggagcugacgggccucgacugcauccgccccugcuucugggucgagcugauccggggccgccccaaggagagcaccguguggaccuccgggagcuccaucagcuucugcggcgucaacuccgacaccgugagcugguccuggcccgacggggccgagcugccguucacgaucgacaaguga

SEQ ID NO: 76009 - RNA, 1350 nt, Artificial Sequence
  derived and/or modified sequence opt1 from neuraminidase__InfluenzaA__ABE97662
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacuccauccggaucggcagcaagggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccaacggccaggccagcuacaagaucuucaagaugcggaagggcaagguggucaaguccguggagcucgacgcccccaacuaccacuacgaggagugcagcugcuaccccgacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccaugucccccaacggcgcguacggggugaagggcuucagcuucaaguacgggaacggcgucuggaucggccggaccaaguccaccaacagccgcuccggguucgagaugaucugggacccgaacggcuggaccgggaccgacagcagcuucuccgugaagcaggacaucguggccaucacggacuggagcggcuacuccgggagcuucguccagcaccccgagcugaccggccucgacugcauccggcccugcuucuggguggagcugauccgcggccggcccaaggaguccaccaucuggaccagcggguccagcaucuccuucugcggcgucaacagcgacacgguguccuggagcuggccggacggggccgagcugcccuucaccaucgacaaguga

SEQ ID NO: 76010 - RNA, 1350 nt, Artificial Sequence
  derived and/or modified sequence opt1 from neuraminidase__InfluenzaA__ABE97663
augaaccccaaccagaagaucaucaccaucggcagcaucugcauggugaccgggaucgucucccugaugcuccagaucggcaacaugaucagcaucugggugucccacagcauccacacggggaaccagcaccaggccgagccgaucuccaacaccaacuuccugaccgagaaggccguggcgagcgucaagcuggccggcaacuccagccucugccccaucaacgggugggccguguacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggccgagcaacggccaggccucccacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuuccgguacgggaacggcguguggaucggccgcaccaaguccaccaacagccgguccggguucgagaugaucugggaccccaacggcuggaccgagaccgacagcagcuucuccgugaagcaggacaucgucgccaucacggacuggagcggguacuccggcagcuucgugcagcacccggagcugaccgggcucgacugcauccgccccugcuucugggucgagcugauccggggccgccccaaggaguccaccaucuggaccagcggcuccagcaucuccuucugcggggugaacagcgacacggugggcugguccuggcccgacggggccgagcugccguucaccaucgacaaguga

SEQ ID NO: 76011 - RNA, 1350 nt, Artificial Sequence
  derived and/or modified sequence opt1 from neuraminidase__InfluenzaA__ABE97665
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcacggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76012 - RNA, 1350 nt, Artificial Sequence
  derived and/or modified sequence opt1 from neuraminidase__InfluenzaA__ABE97666
augaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcccccucugccccaucaacgggugggccguguacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccgguccccgcaccgcacccugaugagcugccccgugggggaggcccccucccccuacaacagccgguucgaguccgucgccuggagcgcgagcgccugccacgacggcaccuccuggcucacgaucgggaucagcggcccggacaacggcgccguggccgugcugaaguacaacgggaucaucaccgacaccaucaaguccuggcgcaacaacauccugcggacccaggagagcgagugcgcgugcgucaacggcuccugcuucacggugaugaccgacgggcccagcaacggccaggccucccacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggccgugggucuccuucaaccagaaccuggaguaccagaucggguacaucugcagcggcguguucggggacagcccccgccccaacgacggcaccggcuccugcgggcccguguccagcaacggcgccuacggggucaagggcuucuccuucaaguacgggaacggcguguggaucggccggaccaagagcaccaacucccgcagcggguucgagaugaucugggacccgaacggcuggaccgagaccgacagcuccuucagcgugaagcaggacaucgucgcgaucacggacugguccggguacagcggcuccuucgugcagcaccccgagcugaccgggcucgacugcauccggcccugcuucugggucgagcugauccgcggccggcccaaggagagcaccaucuggaccuccggcagcuccaucagcuucugcggggugaacuccgacacggugggcuggagcuggccggacggggccgagcugcccuucaccaucgacaaguga

SEQ ID NO: 76013 - RNA, 1350 nt, Artificial Sequence
  derived and/or modified sequence opt1 from neuraminidase__InfluenzaA__ABE97667
augaaccccaaccagaagaucaucaccaucggcagcaucugcauggugaccgggaucgucucccugaugcuccagaucggcaacaugaucagcaucugggggucccacagcauccacacgggcaaccagcaccaguccgagccgaucagcaacaccaacuuccugaccgagaaggccguggccuccgugaagcuggcggggaacagcucccucugccccaucaacggcugggccgucuacagcaaggacaacuccauccgcaucggcagcaagggggacguguucgugauccgggagcccuucaucuccugcagccaccuggagugccgcaccuucuuccugacgcagggcgcccuccugaacgacaagcacuccaacgggaccgucaaggaccggagcccccaccgcacccugauguccugcccggugggcgaggcccccagccccuacaacucccgguucgagagcguggccuggagcgcguccgccugccacgacgggaccagcuggcucacgaucggcaucuccggccccgacaacggggccgucgccguggugaaguacaacggcaucaucaccgacaccaucaagagcuggcgcaacaacauccugcggacccaggaguccgagugcgcgugcgucaacgggagcugcuucacggugaugaccgacggcccguccaacggccaggccagccacaagaucuucaagauggagaaggggaagguggucaaguccguggagcuggacgcccccaacuaccacuacgaggagugcagcugcuaccccgacgccggcaagaucacgugcgugugccgcgacaacuggcacggguccaaccggcccugggucagcuucaaccagaaccucgaguaccagaucggcuacaucugcuccgggguguucggcgacaacccgcgccccaacgacggcaccgggagcugcggccccguguccagcaacggggccuacggcgucaagggguucuccuucaaguacggcaacggcguguggaucgggcggaccaagagcaccaacucccgcagcggcuucgagaugaucugggaccccaacggguggaccgagaccgacagcuccuucagcgugaagcaggacaucgucgcgaucacggacugguccggcuacagcggguccuucgugcagcacccggagcugaccggccuggacugcauccggcccugcuucugggucgagcucauccgcggccggcccaaggagagcaccaucuggaccuccgggagcuccaucagcuucugcggcgugaacuccgacaucgugggguggagcuggcccgacggcgccgagcugccguucacgaucgacaaguga

SEQ ID NO: 76014 - RNA, 1350 nt, Artificial Sequence
  derived and/or modified sequence opt1 from neuraminidase__InfluenzaA__ABE97669
augaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcucccucugccccaucaacgggugggccguguacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccguggucaaguacaacgggaucaucaccgacaccaucaagagcuggcgcaacaacauccugcggacccaggaguccgagugcgcgugcgugaacggcagcugcuucacggugaugaccgacgggccguccaacggccaggccagccacaagaucuucaagauggagaagggcaaggucgugaaguccguggagcuggacgcccccaacuaccacuacgaggagugcagcugcuaccccgacgccggggagaucacgugcgucugccgcgacaacuggcacggcuccaaccggcccugggugagcuucaaccagaaccucgaguaccagaucggguacaucugcuccggcguguucggggacaacccgcgccccaacgacggcaccggcagcugcgggcccgucuccagcaacggcgccuacggggugaagggcuucuccuucaaguacgggaacggcguguggaucggccggaccaagagcaccaacucccgcagcggguucgagaugaucugggaccccaacggcuggaccgagaccgacagcuccuucagcgucaagcaggacaucguggcgaucacggacugguccggguacagcggcuccuucguccagcacccggagcugaccgggcuggacugcauccggcccugcuucuggguggagcucauccgcggccggcccaaggagagcaccaucuggaccuccggcagcuccaucagcuucugcggggugaacuccgacacggucggcuggagcuggcccgacggggccgagcugccguucaccaucgacaaguga

SEQ ID NO: 76015 - RNA, 1350 nt, Artificial Sequence
  derived and/or modified sequence opt1 from neuraminidase__InfluenzaA__ABE97670
augaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcucccucugccccaucaacgggugggccguguacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccguggucaaguacaacgggaucaucaccgacaccaucaagagcuggcgcaacaacauccugcggacccaggaguccgagugcgcgugcgugaacggcagcugcuucacggugaugaccgacgggccguccaacggccaggccagccacaagaucuucaagauggagaagggcaaggucgugaaguccguggagcuggacacccccaacuaccacuacgaggagugcagcugcuaccccgacgccggggagaucacgugcgucugccgcgacaacuggcacggcuccaaccggcccugggugagcuucaaccagaaccucgaguaccagaucggguacaucugcuccggcguguucggggacaacccgcgccccaacgacggcaccggcagcugcgggcccgucuccagcaacggcgccuacggggugaagggcuucuccuucaaguacgggaacggcguguggaucggccggaccaagagcaccaacucccgcagcggguucgagaugaucugggaccccaacggcuggaccgagacggacagcuccuucagcgucaagcaggacaucguggccaucaccgacugguccggguacagcggcuccuucguccagcacccggagcugaccgggcuggacugcauccggcccugcuucuggguggagcucauccgcggccggcccaaggagagcaccaucuggacguccggcagcuccaucagcuucugcggggugaacuccgacaccgucggcuggagcuggcccgacggggcggagcugccguucaccaucgacaaguga

SEQ ID NO: 76016 - RNA, 1350 nt, Artificial Sequence
  derived and/or modified sequence opt1 from neuraminidase__InfluenzaA__ABE97671
augaaccccaaccagaagaucaucaccaucggcagcaucugcauggugaccgggaucgucucccugaugcuccagaucggcaacaugaucagcaucugggugucccacagcauccacacggggaaccagcaccaggccgagccgaucuccaacaccaacuuccugaccgagaaggccguggcgagcgucaagcuggccggcaacuccagccucugccccaucaacgggugggccguguacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggccgagcaacggccaggccucccacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcugaccgggcucgacugcauccggcccugcuucugggucgagcugauccgcggccggcccaaggaguccaccaucuggaccagcggcuccagcaucuccuucugcggggugaacagcgacacggugggcugguccuggcccgacggggccgagcugccguucaccaucgacaaguga

SEQ ID NO: 76017 - RNA, 1350 nt, Artificial Sequence
  derived and/or modified sequence opt1 from neuraminidase__InfluenzaA__ABE97672
augaaccccaaccagaagaucaucaccaucggcagcaucugcauggugaccgggaucgucucccugaugcuccagaucggcaacaugaucagcaucugggugucccacagcauccacacggggaaccagcaccaggccgagccgaucuccaacaccaacuuccugaccgagaaggcccuggcgagcgugaagcucgccggcaacuccagccugugccccaucaacgggugggccgucuacuccaaggacaacagcauccgcaucggcuccaagggcgacguguucgugauccgggagcccuucaucagcugcucccaccuggagugccgcaccuucuuccucacgcagggggcccugcugaacgacaagcacagcaacggcaccgucaaggaccggagcccccaccgcacccucaugagcugcccggugggggaggcccccucccccuacaacagccgguucgaguccguggcguggagcgccagcgccugccacgacggcaccuccuggcugacgaucgggaucagcggccccgacaacggcgccgucgcggugcugaaguacaacgggaucaucaccgacaccaucaaguccuggcgcaacaacauccuccggacccaggagagcgagugcgccugcgugaacggcuccugcuucacggucaugaccgacgggccgagcaacggccaggccucccacaagaucuucaagauggagaagggcaagguggugaaguccgucgagcuggacgcccccaacuaccacuacgaggagugcuccugcuaccccgacgccggggagaucacgugcgugugccgcgacaacuggcacggcagcaaccggcccuggguguccuucaaccagaaccuggaguaccagaucggguacaucugcagcggcgucuucggggacaacccgcgccccaacgacggcaccggcuccugcgggcccgugagcuccaacggcgcguacggggugaagggcuucagcuucaaguacgggaacggcgucuggaucggccggaccaaguccaccaacagccgcuccggguucgagaugaucugggaccccaacggcuggaccgagaccgacagcagcuucuccgugaagcaggacaucguggccaucacggacuggagcggguacuccggcagcuucguccagcacccggagcucaccgggcuggacugcauccggcccugcuucuggguggagcugauccgcggccggcccaaggaguccaccaucuggaccagcggcuccagcaucuccuucugcggggucaacagcgacacggugggcugguccuggcccgacggggccgagcucccguucaccaucgacaaguga

SEQ ID NO: 76018 - RNA, 1350 nt, Artificial Sequence
  derived and/or modified sequence opt1 from neuraminidase__InfluenzaA__ABE97675
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaucgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacccagggggcccuccugaacgacaagcacagcaacggcacggugaaggaccggagcccccaccgcacccugaugagcugcccggucggggaggcccccucccccuacaacagccgguucgaguccguggcguggagcgccagcgccugccacgacggcaccuccuggcucaccaucgggaucagcggccccgacaacggcgccguggcgguccugaaguacaacgggaucaucacggacaccaucaaguccuggcgcaacaacauccugcggacccaggagagcgagugcgccugcgugaacggcuccugcuucaccgugaugacggacgggccgagcaacggccaggccucccacaagaucuucaagaucgagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggagcgagaccgacagcuccuucagcgucaagcaggacaucguggccaucaccgacugguccggguacagcggcuccuucguccagcacccggagcugaccgggcucgacugcauccggcccugcuucuggguggagcugauccgcggccggcccaaggagagcacgaucuggaccuccggcagcuccaucagcuucugcggggugaacuccgacaccgucggcuggagcuggcccgacggggccgagcugccguucaccaucgacaaguga

SEQ ID NO: 76019 - RNA, 1350 nt, Artificial Sequence
  derived and/or modified sequence opt1 from neuraminidase__InfluenzaA__ABE97676
augaaccccaaccagaagaucaucaccaucggcagcaucugcauggugaccgggaucgucucccugaugcuccagaucggcaacaugaucagcaucugggugucccacagcauccacacggggaaccagcaccaggccgagccgaucuccaacaccaacuuccugaccgagaaggccguggcgagcgucaagcuggccggcaacuccagccucugccccaucaacgggugggccguguacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggccgagcaacggccaggccucccacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucaacgacuggagcggguacuccggcagcuucgugcagcacccggagcugacggggcucgacugcauccggcccugcuucugggucgagcugauccgcggccggcccaaggaguccaccaucuggaccagcggcuccagcaucuccuucugcggggugaacagcgacaccgugggcugguccuggcccgacggggccgagcugccguucacgaucgacaaguga

SEQ ID NO: 76020 - RNA, 1350 nt, Artificial Sequence
  derived and/or modified sequence opt1 from neuraminidase__InfluenzaA__ABE97677
augaaccccaaccagaagaucaucaccaucggcagcaucugcauggugaccgggaucgucucccugaugcuccagaucggcaacaucaucagcaucugggugcgccacuccauccacacggggaaccagcaccagagcgagccgaucuccaacaccaacuuccugaccgagaaggccguggccagcgucaagcuggcgggcaacuccagccucugccccaucaacgggugggccguguacuccaaggacaacagcauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugaugagcugcccggugggggaggcccccucccccuacaacagccgcuucgaguccgucgccuggagcgcgagcgccugccacgacggcaccuccuggcucacgaucgggaucagcggccccgacaacggcgccguggccguggucaaguacaacgggaucaucaccgacaccaucaaguccuggcggaacaacauccugcgcacccaggagagcgagugcgcgugcgugaacggcuccugcuucacggugaugaccgacgggccgagcaacggccaggccucccacaagaucuucaagauggagaagggcaaggucgugaaguccguggagcuggacgcccccaacuaccacuacgaggagugcuccugcuaccccgacgccggggagaucacgugcgucugccgggacaacuggcacggcagcaaccgccccuggguguccuucaaccagaaccucgaguaccagaucggguacaucugcagcggcguguucggggacaacccgcggcccaacgacggcaccggcuccugcgggcccgucagcuccaacggcgccuacggggugaagggcuucagcuucaaguacgggaacggcguguggaucggccgcaccaaguccaccaacagccgguccggguucgagaugaucugggaccccaacggcuggaccgagaccgacagcagcuucuccgucaagcaggacaucguggcgaucacggacuggagcggguacuccggcagcuucguccagcacccggagcugaccgggcuggacugcauccgccccugcuucuggguggagcucauccggggccgccccaaggaguccaccaucuggaccagcggcuccagcaucuccuucugcggggugaacagcgacacggucggcugguccuggcccgacggggccgagcugccguucaccaucgacaaguga

SEQ ID NO: 76021 - RNA, 1350 nt, Artificial Sequence
  derived and/or modified sequence opt1 from neuraminidase__InfluenzaA__ABE97679
augaaccccaaccagaagaucaucaccaucggcagcaucugcauggugaccgggaucgucucccugaugcuccagaucggcaacaugaucagcaucugggugcgccacuccauccacacggggaaccagcaccagagcgagccgaucuccaacaccaacuuccugaccgagaaggccguggccagcgucaagcuggcgggcaacuccagccucugccccaucaacgggugggccguguacuccaaggacaacagcauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugaugagcugcccggugggggaggcccccucccccuacaacagccgcuucgaguccgucgccuggagcgcgagcgccugccacgacggcaccuccuggcucacgaucgggaucagcggccccgacaacggcgccguggccguggucaaguacaacgggaucaucaccgacaccaucaaguccuggcggaacaacauccugcgcacccaggagagcgagugcgcgugcgugaacggcuccugcuucacggugaugaccgacgggccgagcaacggccaggccucccacaagaucuucaagauggagaagggcaaggucgugaaguccguggagcuggacgcccccaacuaccacuacgaggagugcuccugcuaccccgacgccggggagaucacgugcgucugccgggacaacuggcacggcagcaaccgccccuggguguccuucaaccagaaccucgaguaccagaucggguacaucugcagcggcguguucggggacaacccgcggcccaacgacggcaccggcuccugcgggcccgucagcuccaacggcgccuacggggugaagggcuucagcuucaaguacgggaacggcguguggaucggccgcaccaaguccaccaacagccgguccggguucgagaugaucugggaccccaacggcuggaccgagaccgacagcagcuucuccgucaagcaggacaucguggcgaucacggacuggagcggguacuccggcagcuucguccagcacccggagcugaccgggcuggacugcauccgccccugcuucuggguggagcucauccggggccgccccaaggaguccaccaucuggaccagcggcuccagcaucuccuucugcggggugaacagcgacacggucggcugguccuggcccgacggggccgagcugccguucaccaucgacaaguga

SEQ ID NO: 76022 - RNA, 1350 nt, Artificial Sequence; identical to SEQ ID NO: 76014
  derived and/or modified sequence opt1 from neuraminidase__InfluenzaA__ABE97680

SEQ ID NO: 76023 - RNA, 1350 nt, Artificial Sequence; identical to SEQ ID NO: 76014
  derived and/or modified sequence opt1 from neuraminidase__InfluenzaA__ABE97681

SEQ ID NO: 76024 - RNA, 1350 nt, Artificial Sequence; identical to SEQ ID NO: 76014
  derived and/or modified sequence opt1 from neuraminidase__InfluenzaA__ABE97682

SEQ ID NO: 76025 - RNA, 1350 nt, Artificial Sequence
  derived and/or modified sequence opt1 from neuraminidase__InfluenzaA__ABE97684
augaaccccaaccagaagaucaucaccaucggcagcaucugcauggugaccgggaucgucucccugaugcuccagaucggcaacaugaucagcaucugggugucccacagcauccacacggggaaccagcaccaggccgagccgaucuccaacaccaacuuccugaccgagaaggccguggcgagcgucaagcuggccggcaacuccagccucugccccaucaacgggugggccguguacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggccgagcaacggccaggccucccacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcugaccgggcucgacugcauccggcccugcuucugggucgagcugauccgcggccggcccaaggaguccaccaucuggaccagcggcuccagcaucuccuucugcggggugaacagcggcacgguggggugguccuggcccgacggcgccgagcugccguucaccaucgacaaguga

SEQ ID NO: 76026 - RNA, 1350 nt, Artificial Sequence
  derived and/or modified sequence opt1 from neuraminidase__InfluenzaA__ABE97685
augaaccccaaccagaagaucaucaccaucggcagcaucugcauggugaccgggaucgucucccugaugcuccagaucggcaacaugaucagcaucugggugucccacagcauccacacggggaaccagcaccaggccgagccgaucuccaacaccaacuuccugaccgagaaggccguggcgagcgucaagcuggccggcaacuccagccucugccccaucaacgggugggccguguacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggccgagcaacggccaggccucccacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcugaccgggcucgacugcauccggcccugcuucugggucgagcugauccgcggccggcccaaggaguccaccaucuggaccagcggcuccagcaucuccuucugcggggugaacagcgacacgggcgggugguccuggcccgacggcgccgagcugccguucaccaucgacaaguga

SEQ ID NO: 76027 - RNA, 1350 nt, Artificial Sequence; identical to SEQ ID NO: 76016
  derived and/or modified sequence opt1 from neuraminidase__InfluenzaA__ABE97686

SEQ ID NO: 76028 - RNA, 1350 nt, Artificial Sequence
  derived and/or modified sequence opt1 from neuraminidase__InfluenzaA__ABE97687
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76029 - RNA, 1350 nt, Artificial Sequence
  derived and/or modified sequence opt1 from neuraminidase__InfluenzaA__ABE97688
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugauguccugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucaucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcgugugggugggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaucaucgacaaguga

SEQ ID NO: 76030 - RNA, 1350 nt, Artificial Sequence
  derived and/or modified sequence opt1 from neuraminidase__InfluenzaA__ABE97690
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcucccugauguccugcccggucggggaggcccccagccccuacaacucccgguucgagagcguggcguggagcgccuccgccugccacgacggcaccagcuggcucaccaucgggaucuccggccccgacaacggcgccguggcgguccugaaguacaacgggaucaucacggacaccaucaagagcuggcgcaacaacauccugcggacccaggaguccgagugcgccugcgugaacggcagcugcuucaccgugaugacggacgggccguccaacggccaggccagccacaagaucuucaagaugaagaagggcaaggucgugaaguccguggagcucgacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucuccagcaacggcgcguacggggugaagggcuucuccuucaaguacgggaacggcguguggaucggccggaccaagagcaccaacucccgcagcggguucgagaugaucugggaccccaacggcuggaccgagaccgacagcuccuucagcgucaagcaggacaucguggccaucaccgacugguccggguacagcggcuccuucguccagcacccggagcugacggggcucgacugcauccggcccugcuucuggguggagcugauccgcggccggcccaaggagagcaccaucuggaccuccggcagcuccaucagcuucugcggggugaacuccgacaccgucggcuggagcuggcccgacggggccgagcugccguucacgaucgacaaguga

SEQ ID NO: 76031 - RNA, 1350 nt, Artificial Sequence
  derived and/or modified sequence opt1 from neuraminidase__InfluenzaA__ABE97691
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugaagcgggagcccugcaucagcugcucccaccugaagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76032 - RNA, 1350 nt, Artificial Sequence
  derived and/or modified sequence opt1 from neuraminidase__InfluenzaA__ABE97694
augaaccccaaccagaagaucaugaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgacagcgugaagcuggcgggcaacuccagccucugccccaucaacgggugggccguguacuccaaggacaacagcauccgcaucggcuccaagggcgacgucuucgugauccgggagcccagcguguccugcagccaccuggagugccgcaccuucuuccugacgcagggggcccuccugaacgacaagcacuccaacggcaccgucaaggaccggagcccccaccgcacccugauguccugcccggugggggaggcccccagccccuacaacucccgguucgagagcguggccuggagcgcguccgccugccacgacggcaccagcuggcucacgaucgggaucuccggccccgacaacggcgccgucgccgugcugaaguacaacgggaucaucaccgacaccaucaagagcuggcgcaacaacauccugcggacccaggaguccgagugcgcgugcgugaacggcagcugcuucacggucaugaccgacgggccguccaacggccaggccagccacaagaucuucaagauggagaagggcaagguggugaaguccgucgagcucgacgcccccaacuaccacuacgaggagugcagcugcuaccccgacgccggggagaucacgugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgggcccguguccagcaacggcgccuacggggugaagggcuucuccuucaaguacgggaacggcgucuggaucggccggaccaagagcaccaacucccgcagcggguucgagaugaucugggaccccaacggcuggaccgagaccgacagcuccuucagcgugaagcaggacgucguggcgaucacggacugguccggguacagcggcuccuucgugcagcacccggagcugaccgggcucgacugcauccggcccugcuucugggucgagcugauccgcggccggcccaaggagagcaccaucuggaccuccggcagcuccaucagcuucugcggggugaacuccgacacggugggcuggagcuggcccgacggggccgagcugccguucaccaucgacaaguga

SEQ ID NO: 76033 - RNA, 1350 nt, Artificial Sequence
  derived and/or modified sequence opt1 from neuraminidase__InfluenzaA__ABE97696
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcuccgugaaggaccggagcccccaccgcacccugauguccugcagcgucggggaggccccgucccccuacaacagccgguucgagagcguggcgugguccgccagcgccugccacgacggcaccuccuggcucaccaucgggaucagcggccccgacaacggcgccguggcgguccugaaguacaacgggaucaucacggacaccaucaaguccuggcgcaacaacauccugcggacccaggagagcgagugcgccugcgugaacggcuccugcuucaccgugaugacggacgggcccagcaacggccaggccucccacaagaucuucaagauggagaagggcaaggucgucaagagcguggagcucgacgccccgaacuaccacuacgaggagugcuccugcuaccccgacgccggggagaucacgugcgugugccgcgacaacuggcacggcagcaaccggcccuggguguccuucaaccagaaccuggaguaccagaucggguacaucugcagcggcguguucggggacaacccccgcccgaacgacggcaccggcuccugcgggcccgucagcuccaacggcgcguacggggugaagggcuucagcuucaaguacgggaacggcguguggaucggccggaccaaguccaccaacagccgcagcggguucgagaugaucugggaccccaacggcuggaccgagaccgacuccagcuucuccgucaagcaggacaucguggccaucaccgacuggagcggguacuccggcagcuucguccagcaccccgagcugacggggcucgacugcauccggccgugcuucuggguggagcugauccgcggccggcccaaggaguccaccaucuggaccagcggcuccagcaucuccuucugcggggugaacagcgacaccgucggcugguccuggcccgacggggccgagcugcccuucacgaucgacaaguga

SEQ ID NO: 76034 - RNA, 1350 nt, Artificial Sequence
  derived and/or modified sequence opt1 from neuraminidase__InfluenzaA__ABE97697
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaacgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacccagggggcccuccugaacgacaagcacagcaacggcacggugaaggaccggagcccccaccgcacccugaugagcugcccggucggggaggcccccucccccuacaacagccgguucgaguccguggcguggagcgccagcgccugccacgacggcaccuccuggcucaccaucgggaucagcggccccgacaacggcgccguggcgguccugaaguacaacgggaucaucacggacaccaucaaguccuggcgcaacaacauccugcggacccaggagagcgagugcgccugcgugaacggcuccugcuucaccgugaugacggacgggccgagcaacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacgagaccggcuccugcggccccgucagcuccaacggggcguacggcgugaagggguucagcuucaaguacggcaacgggguguggaucggccggaccaaguccaccaacagccgcuccggcuucgagaugaucugggaccccaacggguggaccgagaccgacagcagcuucuccgucaagcaggacaucguggccaucaccgacuggagcggcuacuccgggagcuucguccagcacccggagcugacgggccucgacugcauccggcccugcuucuggguggagcugauccgcgggcggcccaaggaguccaccaucuggaccagcggcuccagcaucuccuucugcggcgugaacagcgacaccgucgggugguccuggcccgacggcgccgagcugccguucacgaucgacaaguga

SEQ ID NO: 76035 - RNA, 1350 nt, Artificial Sequence
  derived and/or modified sequence opt1 from neuraminidase__InfluenzaA__ABE97702
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucgacgcccccuacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucgugagcaucacggacugguccggguacagcggcuccuucguccagcacccggagcugaccgggcucgacugcauccggcccugcuucuggguggagcugauccgcggccggcccaaggagagcaccaucuggaccuccggcagcuccaucagcuucugcggggugaacuccgacacggucggcuggagcuggcccgacggggccgagcugccguucaccaccgacaaguga

SEQ ID NO: 76036 - RNA, 1350 nt, Artificial Sequence; identical to SEQ ID NO: 76028
  derived and/or modified sequence opt1 from neuraminidase__InfluenzaA__ABE97703

SEQ ID NO: 76037 - RNA, 1350 nt, Artificial Sequence; identical to SEQ ID NO: 76028
  derived and/or modified sequence opt1 from neuraminidase__InfluenzaA__ABE97705

SEQ ID NO: 76038 - RNA, 1350 nt, Artificial Sequence
  derived and/or modified sequence opt1 from neuraminidase__InfluenzaA__ABE97706
augaaccccaaccagaagaucaucaccaucggcagcaucugcauggugaccgggaucgucucccugaugcuccaggugggcaacaugaucagccugugggugucccacagcauccacacggggaaccagcaccaggccgagccgaucuccaacaccaacuuccugaccgagcgcgccgucgcgagcgugaagcucgccggcaacuccagccugugccccaucaacgggugggccguguacuccaaggacaacagcauccggaucggcuccaagggcgacgucuucgugauccgcgagcccuucaucagcugcucccaccuggagugccggaccuucuuccucacgcagggggcccugcugaacgacaagcacagcaacggcaccgugaaggaccgcagcccccaccggacccucaugagcugcccggucggggaggcccccucccccuacaacagccgcuucgaguccguggcguggagcgccagcgccugccacgacggcaccuccuggcugacgaucgggaucagcggccccgacaacggcgccguggcgguccugaaguacaacgggaucaucaccgacaccaucaaguccuggcggaacaacauccuccgcacccaggagagcgagugcgccugcgugaacggcuccugcuucacggugaugaccgacgggccgagcaacggccaggccucccacaagaucuucaagauggagaagggcaaggucgugaaguccguggagcuggacgcccccaacuaccacuacgaggagugcuccugcuaccccgacgccggggagaucacgugcgucugccgggacaacuggcacggcagcaaccgccccuggguguccuucaaccagaaccuggaguaccagaucggguacaucugcagcggcguguucggggacaacccgcggcccaacgacggcaccggcuccugcgggcccgucagcuccaacggcgcguacggggugaagggcuucagcuucaaguacgggaacggcguguggaucggccgcaccaaguccaccagcucccggagcggguucgagaugaucugggaccccaacggcuggaccgagaccgacagcuccuucagcgucaagcaggacaucguggccaucacggacugguccggguacagcggcuccuucguccagcacccggagcucaccgggcuggacugcauccgccccugcuucuggguggagcugauccggggccgccccaaggagagcaccaucugggccuccggcagcuccaucagcuucugcggggugaacuccgacaccgucggcuggagcuggcccgacggggccgagcucccguucacgaucgacaaguga

SEQ ID NO: 76039 - RNA, 1350 nt, Artificial Sequence
  derived and/or modified sequence opt1 from neuraminidase__InfluenzaA__ABE97707
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaaggggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76040 - RNA, 1350 nt, Artificial Sequence
  derived and/or modified sequence opt1 from neuraminidase__InfluenzaA__ABE97708
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcacggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagaugaagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76041 - RNA, 1350 nt, Artificial Sequence
  derived and/or modified sequence opt1 from neuraminidase__InfluenzaA__ABE97710
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucaacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucucccugaagcaggacaucgucgccaucacggacuggagcggguacuccggcagcuucgugcagcacccggagcucaccgggcuggacugcauccggcccugcuucugggucgagcugauccgcggccggcccaaggaguccaccaucuggaccagcggcuccagcaucuccuucugcggggugaacagcgacacggugggcugguccuggcccgacggggccgagcucccguucaccaucgacaaguga

SEQ ID NO: 76042 - RNA, 1350 nt, Artificial Sequence
  derived and/or modified sequence opt1 from neuraminidase__InfluenzaA__ABE97711
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcgacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagauggucugggaccccaacggcuggaccgagaccgacagcagcuucuccgugaagcaggacaucgucgccaucacggacuggagcggguacuccggcagcuucgugcagcacccggagcugaccgggcucgacugcauccggcccugcuucuggguggagcugauccgcggccggcccaaggaguccaccaucuggaccagcggcuccagcaucuccuucugcggggucaacagcgacacggugggcugguccuggcccgacggggccgagcugccguucaccaucgacaaguga

SEQ ID NO: 76043 - RNA, 1350 nt, Artificial Sequence; identical to SEQ ID NO: 76028
  derived and/or modified sequence opt1 from neuraminidase__InfluenzaA__ABE97712

SEQ ID NO: 76044 - RNA, 1350 nt, Artificial Sequence; identical to SEQ ID NO: 76028
  derived and/or modified sequence opt1 from neuraminidase__InfluenzaA__ABE97713

SEQ ID NO: 76045 - RNA, 1350 nt, Artificial Sequence; identical to SEQ ID NO: 76028
  derived and/or modified sequence opt1 from neuraminidase__InfluenzaA__ABE97715

SEQ ID NO: 76046 - RNA, 1350 nt, Artificial Sequence
  derived and/or modified sequence opt1 from neuraminidase__InfluenzaA__ABE97717
augaaccccaaccagaagaucaucaccaucggcagcaucugcauggugaccgggaucgucaaccugaugcuccaggugggcaacaugaucuccaucugggugagccacuccauccacacggggaaccagcaccaggccgagccgaucagcaacaccaacuuccugaccgagaaggccgucgcguccgugaagcuggccggcaacagcucccucugccccaucaacgggugggccguguacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccggucggggaggcccccagccccuacaacucccgguucgagagcguggcgugguccgccagcgccugccacgacggcaccagcuggcucacgaucgggaucuccggccccgacaacggcgccguggcgguccugaaguacaacgggaucaucaccgacaccaucaagagcuggcgcaacaacauccugcggacccaggaguccgagugcgccugcgugaacggcagcugcuucacggugaugaccgacgggccguccaacggccaggccagccacaagaucuucaagauggagaagggcaaggucgugaaguccguggagcucgacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccguccccuccaacggcgcguacggggugaagggcuucagcuucaaguacgggaacggcguguggaucggccggaccaaguccaccaacagccgcuccggguucgagaugaucugggacccgaacggcuggaccgagaccgacagcuccuucagcgucaagcaggacaucguggccaucacggacuggagcggguacuccggcagcuucguccagcaccccgagcugaccgggcucgacugcauccggcccugcuucuggguggagcugauccgcggccggcccaaggaguccaccaucuggaccagcggcuccagcaucuccuucugcggggugaacagcgacacggucggcugguccuggccggacggggccgagcugcccuucaccaucgacaaguga

SEQ ID NO: 76047 - RNA, 1350 nt, Artificial Sequence
  derived and/or modified sequence opt1 from neuraminidase__InfluenzaA__ABE97718
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcgggguggacagcgacacggucggcugguccuggcccgacggggccgagcugccguucaccaucgacaaguga

SEQ ID NO: 76048 - RNA, 1350 nt, Artificial Sequence
  derived and/or modified sequence opt1 from neuraminidase__InfluenzaA__ABE97719
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacaccaacuuccugaccgagaaggccgucgcgagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcucacgaucgggaucagcggccccgacaacggcgccguggcgguccugaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagaugaagaagggcaaggucgugaaguccguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagcuccaacggcgcguacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76049 - RNA, 1350 nt, Artificial Sequence
  derived and/or modified sequence opt1 from neuraminidase__InfluenzaA__ABE97720
augaaccccaaccagaagaucaucaccaucggcagcaucugcauggugaccgggaucgucucccugaugcuccaggugggcaacaugaucagcaucugggugucccacagcauccacacggggaaccagcaccaggccgagccgaucuccaacgccaacuuccugaccgagaaggcggucgccagcgugaagcuggccggcaacuccagccucugccccaucaacgggugggccguguacuccaaggacaacagcauccgcaucggcuccaagggcgacgucuucgugauccgggagcccuucaucagcugcucccaccuggagugccgcaccuucuuccugacccagggggcccuccugaacgacaagcacagcaacggcacggugaaggaccggagcccccaccgcacccugaugagcugcccggucggggaggcgcccucccccuacaacagccgguucgaguccguggccuggagcgccagcgccugccacgacggcaccuccuggcucaccaucgggaucagcggccccgacaacggcgcgguggccguccugaaguacaacgggaucaucacggacaccaucaaguccuggcgcaacaacauccugcggacccaggagagcgagugcgccugcgugaacggcuccugcuucaccgugaugacggacgggccgagcaacggccaggccucccacaagaucuucaagauggagaagggcaaggucgugaaguccguggagcucgacgcccccaacuaccacuacgaggagugcuccugcuaccccgacgcgggggagaucacgugcgucugccgcgacaacuggcacggcagcaaccggcccuggguguccuucaaccagaaccuggaguaccagaucggguacaucugcagcggcguguucggggacaccccgcgccccaacgacggcaccggcuccugcgggcccgucagcuccaacggcgccuacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucacggacuggagcggguacuccggcagcuucguccagcacccggagcugaccgggcucgacugcauccggcccugcuucuggguggagcugauccgcggccggcccaaggaguccaccaucuggaccagcggcuccagcaucuccuucugcggggugaacagcgacacggucggcugguccuggcccgacggggccgagcugccguucaccaucgacaaguga

SEQ ID NO: 76050 - RNA, 1410 nt, Artificial Sequence; identical to SEQ ID NO: 75821
  derived and/or modified sequence opt1 from neuraminidase__InfluenzaA__ABF47553

SEQ ID NO: 76051 - RNA, 1413 nt, Artificial Sequence; identical to SEQ ID NO: 75404
  derived and/or modified sequence opt1 from neuraminidase__InfluenzaA__ABF47564

SEQ ID NO: 76052 - RNA, 1413 nt, Artificial Sequence
  derived and/or modified sequence opt1 from neuraminidase__InfluenzaA__ABF47575
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucgcccuggccggcaacuccagccugugcuccaucagcggcugggccaucuacaccaaggacaacuccauccggaucgggagcaagggcgacguguucgugauccgcgagccguucaucuccugcagccacuucgagugccggaccuucuuccucacgcagggggcccugcugaacgacaagcacuccaacggcaccgucaaggaccgcagccccuaccgggcgcucauguccugcccccugggggaggcccccagcccguacaacagcaaguucgaguccguggccuggagcgccuccgcgugccacgacggcaugggcuggcugaccaucgggaucagcggccccgacaacggggccguggccguccucaaguacaacggcaucaucaccgagacgaucaaguccuggaagaagcagauccugcgcacccaggagagcgagugcgugugcgugaacggcuccugcuucaccaucaugaccgacgggcccagcaacggcgccgccuccuacaagaucuucaagaucgagaaggggaaggucaccaagagcaucgagcugaacgcgcccaacuuccacuacgaggagugcuccugcuacccggacacgggcaccgugaugugcgugugccgggacaacuggcacgggagcaaccgccccugggucuccuucaaccagaaccucgacuaccagaucggcuacaucugcagcggcguguucggggacaacccccggcccaaggacggcgagggguccugcaacccggugaccgucgacggcgccaacggggugaagggcuucagcuacaaguacggcaacgggguguggaucggccgcacgaaguccaaccggcugcgcaagggguucgagaugaucugggaccccaacggcuggaccgacaccgacagcgacuucuccgucaagcaggacgugguggccaucaccgacuggagcggguacagcggcuccuucguccagcaccccgagcugacgggccucgacugcauccggcccugcuucuggguggagcugguccgcgggcugccgaaggagaacaccaccaucuggaccagcggcuccagcaucuccuucugcggggugaacagcgacacggccaacugguccuggcccgacggcgccgagcuccccuucaccaucgacaaguga

SEQ ID NO: 76053 - RNA, 1413 nt, Artificial Sequence; identical to SEQ ID NO: 75404
  derived and/or modified sequence opt1 from neuraminidase__InfluenzaA__ABF47586

SEQ ID NO: 76054 - RNA, 1410 nt, Artificial Sequence; identical to SEQ ID NO: 75134
  derived and/or modified sequence opt1 from neuraminidase__InfluenzaA__ABF47597

SEQ ID NO: 76055 - RNA, 1413 nt, Artificial Sequence; identical to SEQ ID NO: 75976
  derived and/or modified sequence opt1 from neuraminidase__InfluenzaA__ABF47608

SEQ ID NO: 76056 - RNA, 1410 nt, Artificial Sequence
  derived and/or modified sequence opt1 from neuraminidase__InfluenzaA__ABF47619
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcgccuccagcucccacugccugaaccccaacaacgaggagggcgggcacggggucaagggcugggccuucgacgacggcaacgacguguggauggggcggaccaucagcgagaagcugcgcuccggcuacgagaccuucaaggucaucgggggcuggagcaagccgaacuccaagcuccagaucaaccgccaggugaucguggaccgggggaaccggagcggcuacuccggcaucuucagcgucgaggggaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggcgccgacaucaaccugaugcccaucuga

SEQ ID NO: 76057 - RNA, 1413 nt, Artificial Sequence
  derived and/or modified sequence opt1 from neuraminidase__InfluenzaA__ABF47630
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcauggcccuggccggcaacuccagccugugcccgauccggggcugggccaucuacaccaaggacaacuccauccgcaucgggagcaagggcgacgucuucgugauccgggagcccuucaucuccugcagccaccucgagugccgcaccuucuuccugacgcagggggcccugcucaacgacaagcacuccaacggcaccgugaaggaccggagccccuaccgcgcgcugauguccugcccccugggggaggccccgagccccuacaacucccgguucgagagcgucgccuggagcgccuccgcgugccacgacggccucggcuggcugaccaucgggaucagcggccccgacaacggggccguggccgugcugaaguacaacggcaucaucaccgagacgaucaaguccuggaagaagcgcauccuccggacccaggagagcgagugcgucugcaugaacggcuccugcuucaccaucaugaccgacgggcccagcaacggcgccgccuccuaccgcaucuucaagaucgagaaggggcgggugaccaagagcaucgagcuggacgcgccgaacuaccacuacgaggagugcuccugcuaccccgacacgggcaccgugaugugcgucugccgcgacaacuggcacgggagcaaccggcccuggguguccuucaaccagaaccuggacuaccagaucggcuacaucugcagcggcguguucggggacaacccccgcccgaaggacggcgagggguccugcaaccccgucaccguggacggcgccgacggggugaagggcuucagcuaccgguacggcaacggggucuggaucggccgcacgaaguccaaccggcuccgcaagggguucgagaugaucugggaccccaacggcuggaccgacaccgacagcgacuucuccaugaagcaggacaucguggccaugaccgacuggagcggguacuccggcagcuucgugcagcaccccgagcugacgggccuggacugcaugcggccgugcuucugggucgagcucgugcgcgggcugccccgggagaacaccaccaucuggaccagcggcuccagcaucuccuucugcggggugaacagcgacacggccaacugguccuggcccgacggcgccgagcugcccuucaccaucgacaaguga

SEQ ID NO: 76058 - RNA, 1413 nt, Artificial Sequence
  derived and/or modified sequence opt1 from neuraminidase__InfluenzaA__ABF47652
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccaacaccggcaccgugaugugcgucugccgcgacaacuggcacgggagcaaccggcccuggguguccuucaaccagaaccuggacuaccagaucggcuacaucugcagcggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagaugaucugggaccccaacggcuggaccgacaccgacagcgacuucuccaugaagcaggacaucguggccaugacggacuggagcggguacuccggcagcuucgugcagcaccccgagcugaccggccuggacugcaugcggccgugcuucugggucgagcucgugcgcgggcugccccgggagaacaccaccaucuggacgagcggcuccagcaucuccuucugcggggugaacagcgacaccgccaacugguccuggcccgacggcgccgagcugcccuucaccaucgacaaguga

SEQ ID NO: 76059 - RNA, 1413 nt, Artificial Sequence; identical to SEQ ID NO: 75976
  derived and/or modified sequence opt1 from neuraminidase__InfluenzaA__ABF47663

SEQ ID NO: 76060 - RNA, 1413 nt, Artificial Sequence
  derived and/or modified sequence opt1 from neuraminidase__InfluenzaA__ABF47674
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcauccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 76061 - RNA, 1413 nt, Artificial Sequence; identical to SEQ ID NO: 75959
  derived and/or modified sequence opt1 from neuraminidase__InfluenzaA__ABF47696

SEQ ID NO: 76062 - RNA, 1413 nt, Artificial Sequence
  derived and/or modified sequence opt1 from neuraminidase__InfluenzaA__ABF47707
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaagggcaccaccagcaugacccuggcgggcaacuccagccugugcccgauccgggggugggccaucuacuccaaggacaacagcauccgcaucggcuccaagggggacguguucgugauccgggagcccuucaucagcugcucccaccucgagugccgcacguucuuccugacccagggcgcccugcucaacgacaagcacagcaacgggaccgucaaggaccggucccccuaccgcgcccugaugagcugccccaucggcgaggccccgucccccuacaacagccgguucgagagcguggcgugguccgccagcgccugccacgacggcaugggguggcugaccaucggcaucuccgggcccgacgacggcgccguggcgguccucaaguacaacggcaucaucacggagaccaucaagagcuggcgcaagcagauccugcggacccaggaguccgagugcgugugcgugaacgggagcugcuucaccaucaugacggacggccccuccgacgggccggccagcuaccgcaucuucaagaucgagaagggcaagaucaccaaguccaucgagcuggacgcccccaacagccacuacgaggagugcuccugcuaccccgacaccgggaccgucaugugcgugugccgggacaacuggcacggcagcaaccgccccuggguguccuucaaccagaaccucgacuaccagaucggcuacaucugcagcggggucuucggcgacaacccgcggcccaaggacgggaagggcuccugcgaccccgugaacguggacggggccgacggcgucaagggcuucagcuaccgcuacgggaacggcguguggaucgggcggacgaaguccaacagcucccgcaagggcuucgagaugaucugggaccccaacggguggaccgacaccgacagcaacuuccuggugaagcaggacgucguggccaugaccgacuggagcggcuacuccggcagcuucgugcagcacccggagcugacggggcucgacugcaugcggcccugcuucugggucgagcugauccgcggccggccccgcgagaagaccaccaucuggaccuccgggagcuccaucagcuucugcggcgugaacuccgacacggucaacuggagcuggcccgacggcgcggagcugccguucaccaucgacaaguga

SEQ ID NO: 76063 - RNA, 1413 nt, Artificial Sequence; identical to SEQ ID NO: 75959
  derived and/or modified sequence opt1 from neuraminidase__InfluenzaA__ABF47718

SEQ ID NO: 76064 - RNA, 1413 nt, Artificial Sequence; identical to SEQ ID NO: 75959
  derived and/or modified sequence opt1 from neuraminidase__InfluenzaA__ABF47729

SEQ ID NO: 76065 - RNA, 1413 nt, Artificial Sequence; identical to SEQ ID NO: 75959
  derived and/or modified sequence opt1 from neuraminidase__InfluenzaA__ABF47740

SEQ ID NO: 76066 - RNA, 1413 nt, Artificial Sequence
  derived and/or modified sequence opt1 from neuraminidase__InfluenzaA__ABF47751
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacagcucccugugcccgauccggggcugggccaucuacagcaaggacaacuccauccgcaucgggagcaagggcgacguguucgucauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagagcgagugcgugugcgucaacggcuccugcuucaccaucaugacggacgggcccagcaacggcccggccuccuaccggaucuucaagaucgagaaggggaagaucaccaagagcaucgagcuggacgcccccaacucccacuacgaggagugcagcugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugacggucgacggcgccgacggggugaagggcuucuccuaccgguacggcaacgggguguggaucggccgcaccaagagcaacuccagccggaagggguucgagaugaucugggaccccaacggcuggaccgacaccgacuccaacuuccuggucaagcaggacgugguggccaugacggacuggagcggguacagcggcuccuucguccagcacccggagcugaccggccucgacugcaugcgccccugcuucuggguggagcugauccgggggcgcccccgggagaagaccaccaucuggacgagcggcuccagcaucuccuucugcggggucaacagcgacaccgcgaacugguccuggcccgacggcgccgagcugccguucaccaucgacaaguga

SEQ ID NO: 76067 - RNA, 1413 nt, Artificial Sequence
  derived and/or modified sequence opt1 from neuraminidase__InfluenzaA__ABF47773
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccagcaacggcccggcguccuaccggaucuucaagaucgagaaggggaagaucaccaagagcaucgagcuggacgcccccaacucccacuacgaggagugcagcugcuaccccgacaccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggaccgacacggacuccaacuuccuggucaagcaggacgugguggccaugaccgacuggagcggguacagcggcuccuucguccagcacccggagcugaccggccucgacugcaugcgccccugcuucuggguggagcugauccgggggcgcccccgggagaagaccacgaucuggaccagcggcuccagcaucuccuucugcggggucaacagcgacaccgccaacugguccuggcccgacggcgcggagcugccguucaccaucgacaaguga

SEQ ID NO: 76068 - RNA, 1413 nt, Artificial Sequence; identical to SEQ ID NO: 76067
  derived and/or modified sequence opt1 from neuraminidase__InfluenzaA__ABF47784

SEQ ID NO: 76069 - RNA, 1413 nt, Artificial Sequence; identical to SEQ ID NO: 76067
  derived and/or modified sequence opt1 from neuraminidase__InfluenzaA__ABF47795

SEQ ID NO: 76070 - RNA, 1413 nt, Artificial Sequence; identical to SEQ ID NO: 76067
  derived and/or modified sequence opt1 from neuraminidase__InfluenzaA__ABF47806

SEQ ID NO: 76071 - RNA, 1413 nt, Artificial Sequence; identical to SEQ ID NO: 76067
  derived and/or modified sequence opt1 from neuraminidase__InfluenzaA__ABF47817

SEQ ID NO: 76072 - RNA, 1413 nt, Artificial Sequence; identical to SEQ ID NO: 76067
  derived and/or modified sequence opt1 from neuraminidase__InfluenzaA__ABF47839

SEQ ID NO: 76073 - RNA, 1413 nt, Artificial Sequence; identical to SEQ ID NO: 76067
  derived and/or modified sequence opt1 from neuraminidase__InfluenzaA__ABF47850

SEQ ID NO: 76074 - RNA, 1413 nt, Artificial Sequence; identical to SEQ ID NO: 75836
  derived and/or modified sequence opt1 from neuraminidase__InfluenzaA__ABF47872

SEQ ID NO: 76075 - RNA, 1413 nt, Artificial Sequence; identical to SEQ ID NO: 75836
  derived and/or modified sequence opt1 from neuraminidase__InfluenzaA__ABF47883

SEQ ID NO: 76076 - RNA, 1413 nt, Artificial Sequence; identical to SEQ ID NO: 75836
  derived and/or modified sequence opt1 from neuraminidase__InfluenzaA__ABF47894

SEQ ID NO: 76077 - RNA, 1410 nt, Artificial Sequence; identical to SEQ ID NO: 75852
  derived and/or modified sequence opt1 from neuraminidase__InfluenzaA__ABF47905

SEQ ID NO: 76078 - RNA, 1362 nt, Artificial Sequence
  derived and/or modified sequence opt1 from neuraminidase__InfluenzaA__ABF47958
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccagggguccaucaccuacaaggugguggccggccaggacagcaccuccgucauccugaccggcaacagcucccugugcccgauccgcgggugggccauccacagcaaggacaacggcauccggaucggguccaagggcgacguguucgugauccgcgagcccuucaucagcugcucccaccucgagugccggacguucuuccugacccagggggcgcugcucaacgacaagcacagccgcggcaccuucaaggaccggucccccuaccgcgcccugaugagcugccccgucggcgaggccccgucccccuacaacagccgguucgaguccguggccuggagcgccagcgcgugccacgacgggaugggcuggcugaccaucgggaucuccggccccgacgacggcgccguggccguccucaaguacaacgggaucaucacggagaccaucaagagcuggcgcaagaacauccugcggacccaggaguccgagugcacgugcgugaacggcagcugcuucaccaucaugaccgacgggcccuccgacggccuggccagcuacaagaucuucaagaucgagaaggggaaggugaccaaguccaucgagcucaacgcgccgaacagccacuacgaggagugcuccugcuaccccgacaccggcaaggucaugugcgugugccgcgacaacuggcacggcagcaaccggcccuggguguccuucgaccagaaccuggacuacaagaucggguacaucugcagcggcgucuucggggacaacccccgcccgaaggacggcacgggguccugcggccccgugagcgccgacggcgccaacggggugaagggcuucuccuacaaguacgggaacggcgucuggaucgggcggaccaagagcgacuccagccgccacggcuucgagaugaucugggaccccaacggcuggaccgagaccgacucccgguucagcaugcgccaggacgugguggccaugacggaccggagcggguacuccggcagcuucguccagcaccccgagcugaccgggcucgacugcaugcgcccgugcuucuggguggagcugauccggggccugcccgaggaggacgccaucuggaccuccggcagcaucaucuccuucugcggggugaacagcgacaccgucgacugguccuggcccgacggcgcggagcuccccuucacgaucgacaaguga

SEQ ID NO: 76079 - RNA, 1350 nt, Artificial Sequence
  derived and/or modified sequence opt1 from neuraminidase__InfluenzaA__ABF56651
augaaccccaaccagaagaucaucaccaucggcagcaucugcauggugaccgggaucgucucccugaugcuccaggugggcaacaugaucagcaucugggugucccacagcauccacacggggucccagcaccaggccgagccgaucagcaacaccaacuuccugaccgagaaggccgucgcguccgugaagcuggccggcaacagcucccucugccccaucaacgggugggccguguacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccggucggggaggcccccagccccuacaacucccgguucgagagcguggcguggagcgccuccgccugccacgacggcaccagcuggcucacgaucgggaucuccggccccgacaacggcgccguggcgguccugaaguacaacgggaucaucaccgacaccaucaagagcuggcgcaacaacauccugcggacccaggaguccgagugcgccugcgugaacggcagcugcuucacggugaugaccgacgggccguccaacggccaggccagccacaagaucuucaagauggagaagggcaaggucgugaaguccguggagcucgacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucuccagcaacggcgcguacggggugaagggcuucuccuucaaguacgggaacggcguguggaucggccggaccaagagcaccaacucccgcagcggguucgagaugaucugggaccccaacggcuggaccgagaccgacagcuccuucagcgucaagcaggacaucguggccaucacggacugguccggguacagcggcuccuucguccagcacccggagcugaccgggcucgacugcauccggcccugcuucuggguggagcugauccgcggccggcccaaggagagcaccaucuggaccuccggcagcuccaucagcuucugcggggugaacuccgacacggucggcuggagcuggcccgacggggccgagcugccguucaccaucgacaaguga

SEQ ID NO: 76080 - RNA, 1410 nt, Artificial Sequence; identical to SEQ ID NO: 75835
  derived and/or modified sequence opt1 from neuraminidase__InfluenzaA__ABF82654

SEQ ID NO: 76081 - RNA, 1413 nt, Artificial Sequence; identical to SEQ ID NO: 75404
  derived and/or modified sequence opt1 from neuraminidase__InfluenzaA__ABF82665

SEQ ID NO: 76082 - RNA, 1413 nt, Artificial Sequence; identical to SEQ ID NO: 75404
  derived and/or modified sequence opt1 from neuraminidase__InfluenzaA__ABF82676

SEQ ID NO: 76083 - RNA, 1413 nt, Artificial Sequence
  derived and/or modified sequence opt1 from neuraminidase__InfluenzaA__ABF82687
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaagaccaccaagagcaucgagcucaacgcccccaacuuccacuacgaggagugcuccugcuacccggacaccggcacggucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggaccgacacggacagcgacuucuccgugaagcaggacgucguggccaucaccgacuggagcggguacagcggcuccuucgugcagcaccccgagcucaccggccugaacugcauccggcccugcuucugggucgagcuggugcgcgggcucccgaaggagaacaccacgaucuggaccagcggcuccagcaucuccuucugcggggucaacagcgacaccgccaacugguccuggcccgacggcgccgagcugcccuucaccaucgacaaguga

SEQ ID NO: 76084 - RNA, 1410 nt, Artificial Sequence
  derived and/or modified sequence opt1 from neuraminidase__InfluenzaA__ABF82698
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagcccccugagcggguccgcgcagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccuggaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggacaaggggaaccgguccggcuacagcggcaucuucuccgucgagggcaagagcugcaccaaccggugcuucuacguggagcugauccgcgggcggaagcaggagacggaggugugguggaccagcaacuccaucgucguguucugcgggaccagcggcaccuacgggacgggcuccuggcccgacggcgccgacaucaaccugaugcccaucuga

SEQ ID NO: 76085 - RNA, 1410 nt, Artificial Sequence; identical to SEQ ID NO: 75134
  derived and/or modified sequence opt1 from neuraminidase__InfluenzaA__ABF82709

SEQ ID NO: 76086 - RNA, 1413 nt, Artificial Sequence; identical to SEQ ID NO: 75423
  derived and/or modified sequence opt1 from neuraminidase__InfluenzaA__ABF82822

SEQ ID NO: 76087 - RNA, 1413 nt, Artificial Sequence; identical to SEQ ID NO: 75404
  derived and/or modified sequence opt1 from neuraminidase__InfluenzaA__ABF82833

SEQ ID NO: 76088 - RNA, 1413 nt, Artificial Sequence; identical to SEQ ID NO: 75404
  derived and/or modified sequence opt1 from neuraminidase__InfluenzaA__ABF82844

SEQ ID NO: 76089 - RNA, 1413 nt, Artificial Sequence
  derived and/or modified sequence opt1 from neuraminidase__InfluenzaA__ABF82855
augaaccccaaccagaagaucaucaccaucggcagcaucuccaucgccaucgggaucaucagccugaugcuccagaucggcaacaucaucuccaucugggccagccacuccauccagaucgggagccagaaccacaccggcgugugcaaccagcgcaucaucacguacgagaacuccaccugggucaaccacaccuacgugaacaucaacaacaccaacgugaucgcggggaaggacaagacgagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcagauccugcgcacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccgacaccgacagcgacuucuccgucaagcaggacgugguggccaucaccgacuggagcggguacagcggcuccuucguccagcaccccgagcucacgggccuggacugcauccggcccugcuucuggguggagcugguccgcgggcucccgaaggagaacaccaccaucuggaccagcggcuccagcaucuccuucugcggggugaacagcgacacggccaacugguccuggcccgacggcgccgagcugcccuucaccaucgacaaguga

SEQ ID NO: 76090 - RNA, 1413 nt, Artificial Sequence; identical to SEQ ID NO: 75404
  derived and/or modified sequence opt1 from neuraminidase__InfluenzaA__ABF82866

SEQ ID NO: 76091 - RNA, 1413 nt, Artificial Sequence; identical to SEQ ID NO: 75938
  derived and/or modified sequence opt1 from neuraminidase__InfluenzaA__ABF82888

SEQ ID NO: 76092 - RNA, 1413 nt, Artificial Sequence; identical to SEQ ID NO: 75404
  derived and/or modified sequence opt1 from neuraminidase__InfluenzaA__ABF82910

SEQ ID NO: 76093 - RNA, 1413 nt, Artificial Sequence; identical to SEQ ID NO: 75404
  derived and/or modified sequence opt1 from neuraminidase__InfluenzaA__ABF82921

SEQ ID NO: 76094 - RNA, 1413 nt, Artificial Sequence; identical to SEQ ID NO: 75404
  derived and/or modified sequence opt1 from neuraminidase__InfluenzaA__ABF82932

SEQ ID NO: 76095 - RNA, 1413 nt, Artificial Sequence; identical to SEQ ID NO: 75404
  derived and/or modified sequence opt1 from neuraminidase__InfluenzaA__ABF82943

SEQ ID NO: 76096 - RNA, 1350 nt, Artificial Sequence
  derived and/or modified sequence opt1 from neuraminidase__InfluenzaA__ABG20474
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagccccuaccgcacccugauguccugcccggugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacguccugcggacccaggaguccgagugcgccugcgugaacggcagcugcuucacggugaugaccgacgggccguccaacggccaggccagcuacaagaucuucaagauggagaagggcaaggucgugaaguccguggagcucgacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucucccccaacggcgcguacggggugaagggcuucagcuucaaguacgggaacggcguguggaucggccggaccaaguccaccaacagccgcuccggguucgagaugaucugggacccgaacggcuggaccgggaccgacagcaacuucagcgucaagcaggacaucguggccaucacggacugguccggcuacagcggguccuucguccagcaccccgagcugaccggccucgacugcauccggcccugcuucuggguggagcugauccgcggccggcccaaggagagcaccaucuggaccuccgggagcuccaucuucuucugcggcgugaacagcgacacggucuccuggagcuggccggacggggccgagcugcccuucaccaucgacaaguga

SEQ ID NO: 76097 - RNA, 1410 nt, Artificial Sequence; identical to SEQ ID NO: 75134
  derived and/or modified sequence opt1 from neuraminidase__InfluenzaA__ABG26761

SEQ ID NO: 76098 - RNA, 1410 nt, Artificial Sequence
  derived and/or modified sequence opt1 from neuraminidase__InfluenzaA__ABG26772
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucaaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagccgaacagcaagcuccagaucaaccgccaggugaucguggaccgggggaaccgguccggcuacagcgggaucuucuccgucgagggcaagagcugcaucaaccgcugcuucuacguggagcugauccggggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76099 - RNA, 1413 nt, Artificial Sequence
  derived and/or modified sequence opt1 from neuraminidase__InfluenzaA__ABG26783
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccaacaccggcaccgugaugugcgucugccgcgacaacuggcacgggagcaaccggcccuggguguccuucaaccagaaccuggacuaccagaucggcuacaucugcagcggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagaugaucugggaccccaacggcuggaccgacaccgacagcgacuucuccaugaagcaggacaucguggccaugacggacuggagcggguacuccggcagcuucgugcagcaccccgagcugaccggccuggacugcauccggccgugcuucugggucgagcucgugcgcgggcugccccgggagaacaccaccaucuggacgagcggcuccagcaucuccuucugcggggugaacagcgacaccgccaacugguccuggcccgacggcgccgagcugcccuucaccaucgacaaguga

SEQ ID NO: 76100 - RNA, 1413 nt, Artificial Sequence; identical to SEQ ID NO: 75976
  derived and/or modified sequence opt1 from neuraminidase__InfluenzaA__ABG26794

SEQ ID NO: 76101 - RNA, 1410 nt, Artificial Sequence
  derived and/or modified sequence opt1 from neuraminidase__InfluenzaA__ABG26805
augaaccccaaccagaagaucaucaccaucggcagcgugucccugaccaucgccacgaucugcuuccucacccagaucgccauccuggucaccaccgugacgcugcacuucaagcaguacgagugcagcuccccgcccaacaaccaggugaugcccugcgagcccaucaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaacaagcacuccaacgacaccauccacgaccgcacccccuaccggacccugcucaugaacgagcugggcgugcccuuccaccuggggacgaagcaggucugcaucgccuggagcuccagcuccugccacgacggcaaggccuggcuccacgugugcaucaccgggcacgacaagaacgcgaccgccagcuucaucuacgacggccgccugguggacuccaucgggagcugguccaagaacauccugcggacccaggagagcgagugcgugugcaucaacggcacgugcaccgucgugaugaccgacggcuccgccagcgagcgcgccgacaccaagauccucuucaucgaggaggggaagaucgugcacaucagcccccuguccggcagcgcgcagcacgucgaggagugcuccugcuacccgcgguaccccggggugcgcugcgugugccgggacaacuggaagggcagcaaccgccccaucgucgacaucaacgugaaggacuacuccaucgugagcuccuacgucugcagcggccuggugggggacacgccccggaagaacgaccgcuccagcuccagcuacugccggaacccgaacaacgagaagggcaaccacggggugaagggcugggccuucgacgacgggaacgacgucuggaugggccgcaccaucggcgaggagcuccgguccggguacgagaccuucaaggugaucggcggguggagcacccccaacuccaagcugcagaucaaccgccagaucaucgucgacagcggcaaccgguccggguacagcggcaucuucuccguggagggcaagagcugcaucaaccgcugcuucuacguggagcugauccgggggcgcgagcaggagacgcgcgucugguggaccagcaacuccaucgugguguucugcggcaccagcgggaccuacggcacgggguccuggcccgacggcgccgacaucaaccucaugcccaucuga

SEQ ID NO: 76102 - RNA, 1413 nt, Artificial Sequence; identical to SEQ ID NO: 75959
  derived and/or modified sequence opt1 from neuraminidase__InfluenzaA__ABG26816

SEQ ID NO: 76103 - RNA, 1413 nt, Artificial Sequence; identical to SEQ ID NO: 76067
  derived and/or modified sequence opt1 from neuraminidase__InfluenzaA__ABG26827

SEQ ID NO: 76104 - RNA, 1413 nt, Artificial Sequence; identical to SEQ ID NO: 76067
  derived and/or modified sequence opt1 from neuraminidase__InfluenzaA__ABG26838

SEQ ID NO: 76105 - RNA, 1410 nt, Artificial Sequence
  derived and/or modified sequence opt1 from neuraminidase__InfluenzaA__ABG26860
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucaucgacaucaacgugaaggacuacagcaucguguccagcuacgucugcuccggccucgugggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggagcaagccgaacuccaagcugcagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugugguggacguccaacagcaucguggucuucugcggcaccuccgggaccuacggcaccgggagcuggcccgacggcgccgacaucaaccucaugcccaucuga

SEQ ID NO: 76106 - RNA, 1410 nt, Artificial Sequence
  derived and/or modified sequence opt1 from neuraminidase__InfluenzaA__ABG26871
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuacaaccagaucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgccuccgaccgggcggacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggagcaagccgaacuccaagcugcagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugugguggacguccaacagcaucguggucuucugcggcaccuccgggaccuacggcaccgggagcuggcccgacggcgccgacaucaaccucaugcccaucuga

SEQ ID NO: 76107 - RNA, 1410 nt, Artificial Sequence
  derived and/or modified sequence opt1 from neuraminidase__InfluenzaA__ABG26893
augaaccccaaccagaagaucaucaccaucggcagcaucucccugaccaucgccacgaucugcuuccucaugcagaucgccauccuggugaccaccgucacccugcacuucaagcaguacgagugcaacagcccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgccuccgaccgggcggacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggagcaagccgaacuccaagcugcagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugugguggacguccaacagcaucguggucuucugcggcaccuccgggaccuacggcaccgggagcuggcccgacggcgccgacaucaaccucaugcccaucuga

SEQ ID NO: 76108 - RNA, 1410 nt, Artificial Sequence
  derived and/or modified sequence opt1 from neuraminidase__InfluenzaA__ABG26915
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucuccagcugguccaagaacauccuccgcacccaggagagcgagugcgucugcaucaacgggacgugcaccguggugaugaccgacggcuccgccagcgagcgggcggacaccaagauccuguucaucgaggagggcaagaucguccacaucagcccccuguccgggagcgcccagcacguggaggagugcuccugcuacccccgcuacccgggcgugcggugcgucugccgcgacaacuggaaggggagcaaccggcccaucguggacaucaacgugaaggacuacuccaucgucagcuccuacgugugcagcggccucgugggcgacacgccccgcaagaacgacuccagcuccagcuccuacugccugaaccccaacaacgaggagggcgggcacggggucaagggcugggccuucgacgacgggaacgacguguggaugggccggaccaucagcgagaagcugcgcuccggcuacgagaccuucaaggucaucgggggcuggagcaagccgaacuccaagcuccagaucaaccgccaggugaucguggaccgggggaaccggagcggcuacuccgggaucuucagcgucgagggcaagagcugcgugaaccgcugcuucuacguggagcugauccggggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 76109 - RNA, 1410 nt, Artificial Sequence
  derived and/or modified sequence opt1 from neuraminidase__InfluenzaA__ABG26937
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaaccccaacaacgagaagggcagccacggggucaagggcugggccuucgacgacgggaacgacguguggaugggccgcaccaucuccgaggagcugcggagcggcuacgagaccuucaaggucaucgggggcugguccaagccgaacagcaagcugcagaucaaccgccaggugaucguggaccgggggaaccgcuccggcuacagcgggaucuucagcgucgagggcaaguccugcaucaaccggugcuucuacguggagcucauccgcggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76110 - RNA, 1413 nt, Artificial Sequence; identical to SEQ ID NO: 75404
  derived and/or modified sequence opt1 from neuraminidase__InfluenzaA__ABG26948

SEQ ID NO: 76111 - RNA, 1410 nt, Artificial Sequence; identical to SEQ ID NO: 75174
  derived and/or modified sequence opt1 from neuraminidase__InfluenzaA__ABG26959

SEQ ID NO: 76112 - RNA, 1413 nt, Artificial Sequence
  derived and/or modified sequence opt1 from neuraminidase__InfluenzaA__ABG37123
augaaccccaaccagaagaucaucaccaucggcagcaucuccaucaccaucgggaucaucagccugaugcuccagaucggcaacaucaucuccaucugggccagccacuccauccagacggggagccagaaccacaccggcgugugcaaccagcgcaucaucaccuacgagaacuccaccugggucaaccacacguacgugaacaucaacaacaccaacgugaucgccgggaaggacaagaccagcgucacccuggcgggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcccccagcccguacaacagcaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcagauccugcgcacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugaccgucgacggcgccaacggggugaagggcuucagcuacaaguacggcaacgggguguggaucggccgcaccaaguccaaccggcugcgcaagggguucgagaugaucugggaccccaacggcuggaccgacacggacagcgacuucuccgucaagcaggacgugguggcgaucaccgacuggagcggguacagcggcuccuucguccagcaccccgagcucaccggccuggacugcauccggcccugcuucuggguggagcugguccgcgggcucccgaaggagaacaccacgaucuggaccagcggcuccagcaucuccuucugcggggugaacagcgacaccgccaacugguccuggcccgacggcgccgagcugcccuucaccaucgacaaguga

SEQ ID NO: 76113 - RNA, 1410 nt, Artificial Sequence
  derived and/or modified sequence opt1 from neuraminidase__InfluenzaA__ABG37134
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagccagcugcucggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccuggugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcuccgcuccggguacgagaccuucaaggucaucgagggcuggagcaagcccaacuccaagcugcagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggccggacggggccgacaucaaccucaugcccaucuga

SEQ ID NO: 76114 - RNA, 1410 nt, Artificial Sequence; identical to SEQ ID NO: 75134
  derived and/or modified sequence opt1 from neuraminidase__InfluenzaA__ABG37145

SEQ ID NO: 76115 - RNA, 1410 nt, Artificial Sequence
  derived and/or modified sequence opt1 from neuraminidase__InfluenzaA__ABG37156
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccaacuacgugugcagcgggcucgugggcgacacgccccgcaagaacgacuccagcuccagcucccacugccugaaccccaacaacgaggagggcgggcacggggucaagggcugggccuucgacgacggcaacgacguguggauggggcggaccaucagcgagaagcugcgcuccggcuacgagaccuucaaggucaucgggggcuggagcaagccgaacuccaagcuccagaucaaccgccaggugaucguggaccgggggaaccggagcggcuacuccggcaucuucagcgucgaggggaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggcgccgacaucaaccugaugcccaucuga

SEQ ID NO: 76116 - RNA, 1410 nt, Artificial Sequence
  derived and/or modified sequence opt1 from neuraminidase__InfluenzaA__ABG37167
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucuccagcugguccaagaacauccuccgcacccaggagagcgagugcgucugcaucaacggcacgugcaccguggugaugaccgacggguccgccagcggccgggcggacaccaagauccuguucaucgaggagggcaagaucguccacaucagcccccuguccgggagcgcccagcacguggaggagugcuccugcuacccccgcuacccgggcgugcggugcgucugccgcgacaacuggaaggggagcaaccggcccaucguggacaucaacgugaaggacuacuccaucgucagcuccuacgugugcagcggccucgugggcgacacgccccgcaagaacgacuccagcuccagcuccuacugccugaaccccaacaacgaggagggcgggcacggggucaagggcugggccuucgacgacgggaacgacguguggaugggccggaccaucagcgagaagcugcgcuccggcuacgagaccuucaaggucaucgggggcuggagcaagccgaacuccaagcuccagaucaaccgccaggugaucguggaccgggggaaccggagcggcuacuccgggaucuucagcgucgagggcaagagcugcgugaaccgcugcuucuacguggagcugauccggggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 76117 - RNA, 1410 nt, Artificial Sequence
  derived and/or modified sequence opt1 from neuraminidase__InfluenzaA__ABG37189
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugcuccugugcgagcccacgaucaucgagcgcaacaucaccgagaucgucuaccugaccaacaccacgaucgagaaggagaucugccccaagcucgcggaguaccggaacugguccaagccgcagugcaagaucaccggguucgcccccuucagcaaggacaacuccauccgccugagcgccggcggggacaucugggugacccgggagcccuacguguccugcgaccccggcaagugcuaccaguucgcccuggggcagggcaccacgcucaacaaccgccacagcaacgacaccguccacgaccggaccccguaccgcacccugcugaugaacgagcucggcgugcccuuccaccuggggacgaagcaggucugcaucgccugguccagcuccagcugccacgacggcaaggcguggcugcacgugugcgugaccgggcacgacgagaacgccaccgccuccuucaucuacgacggccggcucguggacagcaucggguccuggagcaagaacauccugcgcacccaggaguccgagugcgucugcaucaacggcacgugcaccguggugaugaccgacggcagcgccuccgggcgggcggacaccaagauccuguucaucgaggagggcaagaucguccacaucagcagccucuccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcuggugggcgacacgccccgcaagaacgacuccagcuccagcucccacugccugaaccccaacaacgaggagggcgggcacggggucaagggcugggccuucgacgacggcaacgacguguggauggggcggaccaucagcgagaagcuccgcuccggcuacgagaccuucaaggucaucgggggcuggagcaagcccaacuccaagcugcagaucaaccgccaggugaucguggaccgggggaaccggagcggcuacuccggcaucuucagcgucgagggcaagagcugcaucaaccgcugcuucuacguggagcugauccgggggcgcaagcaggagaccgaggugugguggacguccaacagcaucgucguguucugcgggaccuccggcaccuacgggaccggcagcuggccggacggcgccgacaucaaccucaugcccaucuga

SEQ ID NO: 76118 - RNA, 1410 nt, Artificial Sequence
  derived and/or modified sequence opt1 from neuraminidase__InfluenzaA__ABG37200
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgacagcggcaagugcuaccaguucgcccuggggcagggcaccacgcugaacaaccgccacuccaacgacaccguccacgaccggacccccuaccgcacccuccugaugaacgagcugggcgugccguuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgggcgggcggacaccaagauccuguucaucgaggagggcaagaucguccacaucagcacgcuguccgggagcgcccagcacguggaggagugcuccugcuacccccgcuaccccggcgugcggugcgucugccgcgacaacuggaagggcagcaaccggcccaucguggacaucaacgugaaggacuacuccaucgucagcuccuacgugugcagcgggcucgugggcgacaccccgcgcaagaacgacuccagcuccagcucccacugccugaaccccaacaacgaggagggcgggcacggggucaagggcugggccuucgacgacggcaacgacguguggauggggcggaccaucagcgagaagcugcgcuccggcuacgagaccuucaaggucaucgggggcuggagcaagcccaacuccaagcuccagaucaaccgccaggugaucguggaccgggggaaccggagcggcuacuccggcaucuucagcgucgagggcaagagcugcaucaaccgcugcuucuacguggagcugauccgggggcgcaagcaggagacggaggugugguggaccuccaacagcaucgucguguucugcgggaccuccggcaccuacgggacgggcagcuggcccgacggcgccgacaucaaccugaugccgaucuga

SEQ ID NO: 76119 - RNA, 1410 nt, Artificial Sequence
  derived and/or modified sequence opt1 from neuraminidase__InfluenzaA__ABG37211
augaaccccaaccagaagaucaucaccaucggcagcgugucccugaccaucgccacgaucugcuuccucacccagaucgccauccuggucaccaccgugacgcugcacuucaagcaguacgagugcagcuccccgcccaacaaccaggugaugcccugcgagcccaucaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaacaagcacuccaacgacaccauccacgaccgcacccccuaccggacccugcucaugaacgagcugggcgugcccuuccaccuggggacgaagcaggucugcaucgccuggagcuccagcuccugccacgacggcaaggccuggcuccacgugugcaucaccgggcacgacaagaacgcgaccgccagcuucaucuacgacggccgccugguggacuccaucgggagcugguccaagaacauccugcggacccaggagagcgagugcgugugcaucaacggcacgugcaccgucgugaugaccgacggcuccgccagcgagcgcgccgacaccaagauccucuucaucgaggaggggaagaucgugcacaucagcccccuguccggcagcgcgcagcacgucgaggagugcuccugcuacccgcgguaccccggggugcgcugcgugugccgggacaacuggaagggcagcaaccgccccaucgucgacaucaacgugaaggacuacuccaucgugagcuccuacgucugcagcggccuggugggggacacgccccggaagaacgaccgcuccagcuccagcuacugccggaacccgaacaacgagaagggcaaccacggggugaagggcugggccuucgacgacgggaacgacgucuggaugggccgcaccaucggcgaggagcuccgguccggguacgagaccuucaaggugaucggcggguggagcacccccaacuccaagcugcagaucaaccgccaggucaucguggacagcggcaaccgguccggguacagcggcaucuucuccguggagggcaagagcugcaucaaccgcugcuucuacgucgagcugauccgggggcgcgagcaggagacgcgcgugugguggaccagcaacuccaucguggucuucugcggcaccagcgggaccuacggcacgggguccuggcccgacggcgccgacaucaaccucaugcccaucuga

SEQ ID NO: 76120 - RNA, 1410 nt, Artificial Sequence
  derived and/or modified sequence opt1 from neuraminidase__InfluenzaA__ABG37233
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggcgaugcucugcgagcccacgaucaucgagcgcaacaucaccgagaucguguaccugaccaacaccacgaucgagaaggagaucugccccaagcuggccgaguaccggaacuggagcaagccgcagugcaagaucaccggguucgcccccuucuccaaggacaacagcauccgccucuccgccggcggggacaucugggucacccgggagcccuacgugagcugcgaccccggcaagugcuaccaguucgcccuggggcagggcaccacgaucaacaaccgccacuccaacgacaccgugcacgaccggaccccguaccgcacccugcucaugaacgagcugggcguccccuuccaccuggggacgaagcaggucugcaucgcguggagcuccagcuccugccacgacggcaaggccuggcuccacgugugcgugaccgggcacgacgagaacgccaccgccagcuucaucuacgacggccggcugguggacuccaucgggagcugguccaagaacauccugcgcacccaggagagcgagugcgugugcaucaacggcacgugcaccgucgugaugaccgacggcuccgcgagcgggcgggccgacaccaagauccucuucaucgaggagggcaagaucgugcacaucagcccccuguccgggagcgcccagcacgucgaggagugcuccugcuacccccgcuacccgggcgugcggugcgugugccgcgacaacuggaagggcagcaaccggcccaucgucgacaucaacgugaaggacuacuccaucgugagcuccuacgucugcagcgggcuggugggcgacacgccccgcaagaacgacuccagcuccaacagcuacugccggaaccccaacaacgagaaggggucccacggcgugaaggggugggccuucgacgacggcaacgacgucuggaugggccgcaccaucagcgccgagucccggagcggguacgagaccuucaaggugaucggcgggugguccaagccgaacagcaagcuccagaucaaccgccaggucaucguggaccggggcaaccgcuccggguacagcggcaucuucagcguggagggcaaguccugcaucaaccggugcuucuacgucgagcugauccgcgggcgcaagcaggagaccgaggugugguggacgagcaacuccaucguggucuucugcggcaccagcgggaccuacggcaccggguccuggcccgacggcgcggacaucaaccugaugcccaucuga

SEQ ID NO: 76121 - RNA, 1410 nt, Artificial Sequence
  derived and/or modified sequence opt1 from neuraminidase__InfluenzaA__ABG37244
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggagcaagccgaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggacguccaacagcaucgucguguucugcggcaccuccgggaccuacggcaccgggagcuggcccgacggcgccgacaucaaccucaugcccaucuga

SEQ ID NO: 76122 - RNA, 1410 nt, Artificial Sequence; identical to SEQ ID NO: 76121
  derived and/or modified sequence opt1 from neuraminidase__InfluenzaA__ABG37255

SEQ ID NO: 76123 - RNA, 1410 nt, Artificial Sequence; identical to SEQ ID NO: 76108
  derived and/or modified sequence opt1 from neuraminidase__InfluenzaA__ABG37266

SEQ ID NO: 76124 - RNA, 1410 nt, Artificial Sequence; identical to SEQ ID NO: 76121
  derived and/or modified sequence opt1 from neuraminidase__InfluenzaA__ABG37277

SEQ ID NO: 76125 - RNA, 1410 nt, Artificial Sequence; identical to SEQ ID NO: 76121
  derived and/or modified sequence opt1 from neuraminidase__InfluenzaA__ABG37288

SEQ ID NO: 76126 - RNA, 1410 nt, Artificial Sequence; identical to SEQ ID NO: 76121
  derived and/or modified sequence opt1 from neuraminidase__InfluenzaA__ABG37310

SEQ ID NO: 76127 - RNA, 1410 nt, Artificial Sequence; identical to SEQ ID NO: 76108
  derived and/or modified sequence opt1 from neuraminidase__InfluenzaA__ABG37321

SEQ ID NO: 76128 - RNA, 1410 nt, Artificial Sequence
  derived and/or modified sequence opt1 from neuraminidase__InfluenzaA__ABG37332
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacaucagcccccugagcggcggggcccagcacguggaggagugcuccugcuacccccgcuacccgggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugcuggaaccccaacaacgagaagggcgggcacggggucaagggcugggccuucgacgacggcaacgacguguggauggggcggaccaucagcgaggagucccgcagcggcuacgagaccuucaaggucaucgggggcugguccaagccgaacagcaagcugcagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccucaugcccaucuga

SEQ ID NO: 76129 - RNA, 1410 nt, Artificial Sequence
  derived and/or modified sequence opt1 from neuraminidase__InfluenzaA__ABG37343
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaagaacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggagcaagccgaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggacguccaacagcaucgucguguucugcggcaccuccgggaccuacggcaccgggagcuggcccgacggcgccgacaucaaccucaugcccaucuga

SEQ ID NO: 76130 - RNA, 1410 nt, Artificial Sequence; identical to SEQ ID NO: 76109
  derived and/or modified sequence opt1 from neuraminidase__InfluenzaA__ABG37354

SEQ ID NO: 76131 - RNA, 1413 nt, Artificial Sequence; identical to SEQ ID NO: 75836
  derived and/or modified sequence opt1 from neuraminidase__InfluenzaA__ABG37365

SEQ ID NO: 76132 - RNA, 1413 nt, Artificial Sequence; identical to SEQ ID NO: 75938
  derived and/or modified sequence opt1 from neuraminidase__InfluenzaA__ABG37387

SEQ ID NO: 76133 - RNA, 1413 nt, Artificial Sequence
  derived and/or modified sequence opt1 from neuraminidase__InfluenzaA__ABG37398
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacaacaccugggucaaccacaccuacgugaacaucaacaacacgaacgugaucgcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcagauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcgaggggagcugcaacccggugacggucgacggcgcgaacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggccaucacggacugguccggguacagcggcagcuucguccagcaccccgagcucaccggccuggacugcauccggcccugcuucuggguggagcugguccgcgggcucccgaaggagaacaccaccaucuggacguccggcagcuccaucagcuucugcggggugaacuccgacaccgccaacuggagcuggcccgacggcgccgagcugcccuucaccaucgacaaguga

SEQ ID NO: 76134 - RNA, 1410 nt, Artificial Sequence
  derived and/or modified sequence opt1 from neuraminidase__InfluenzaA__ABG37409
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcccugcgagcccacgaucaucgagcgcaacaucaccgagaucguguaccucaccaacaccacgaucgagaaggagaucugcccgaagcuggccgaguaccggaacugguccaagccccagugcaacaucaccggguucgcgcccuucagcaaggacaacuccauccgccugagcgccggcggggacaucugggugacccgggagcccuacgucuccugcgacccggacaagugcuaccaguucgcccucggccaggggaccacgcugaacaacggccacagcaacgacaccgugcacgaccgcacccccuaccggacccugcucaugaacgagcugggcgugcccuuccaccuggggacgaagcaggucugcaucgccugguccagcuccagcugccacgacggcaaggccuggcuccacgugugcgugaccggggacgacgagaacgcgaccgccuccuucaucuacaacggccgccuggucgacagcaucggguccuggagcaagaagauccugcggacccaggaguccgagugcgugugcaucaacggcacgugcaccguggucaugaccgacggcagcgccuccgggaaggccgacaccaagauccucuucaucgaggagggcaagaucgugcacacgagccugcugagcggguccgcgcagcacguggaggagugcagcugcuacccccgcuacccgggcguccggugcgugugccgcgacaacuggaagggcuccaaccggcccaucguggacaucaacgucaaggacuacagcaucguguccagcuacgugugcuccgggcucgucggcgacacgccccgcaagaacgacagcuccagcuccagccacugccuggaccccaacaacgaggagggcgggcacggggugaagggcugggccuucgacgaccggaacgacgucuggaugggccgcaccaucuccgagaagcugcggagcggguacgagaccuucaaggugaucgagggcugguccaagccgaacagcaagcuccagaucaaccgccaggugaucgucgaccgggggaaccgcuccggcuacagcgggaucuucuccguggagggcaagagcugcaucaaccggugcuucuacguggagcugauccgcggccggaagcaggagaccgagguccuguggaccagcaacuccaucgugguguucugcgggaccagcggcaccuacgggacgggcuccuggcccgacggggccgacaucaaccucaugcccaucuga

SEQ ID NO: 76135 - RNA, 1410 nt, Artificial Sequence
  derived and/or modified sequence opt1 from neuraminidase__InfluenzaA__ABG37442
augaaccccaaccagaagaucaucaccaucggcagcgugucccugaccaucgccacgaucugcuuccucaugcagaucgccauccuggucaccaccgugacccugcacuucaagcaguucgagugcaacagcccgcccaacaaccaggugaugcucugcgagcccacgaucaucgaggggaacaucaccgagaucgucuaccugaccaacaccacgaucgagaaggagaucugccccaagcuggcggaguaccgcaacugguccaagccgcagugcaacaucaccggcuucgcccccuucagcaaggacaacuccauccggcucagcgccgggggcgacaucugggugacccgcgagcccuacguguccugcgaccccgacaagugcuaccaguucgcccuggggcagggcaccacgcugaacaacggccacagcaacgacaccguccacgaccggaccccguaccgcacccuccugaugaacgagcugggggugcccuuccaccucggcacgcgccaggugugcaucgccugguccagcuccagcugccacgacgggaaggcguggcugcacgucugcgugaccggcgacgacgagaacgccaccgccuccuucaucuacaacgggcggcugguggacagcaucggcuccuggagcaagaagauccuccggacccaggaguccgagugcgucugcaucaacggcacgugcaccguggugaugaccgacgggagcgccuccggcaaggcggacaccaagauccuguucaucgaggaggggaagaucguccacaucagcacgcugagcggcuccgcccagcacguggaggagugcagcugcuacccccgcuaccccggcgugcggugcgucugccgcgacaacuggaagggguccaaccggccgaucguggacaucaacgugaaggacuacagcaucgucuccagcuacgugugcuccggccucgugggggacacgccccgcaagaacgacagcuucuccagcucccacugccuggaccccaacaacgaggagggcgggcacggcgucaagggcugggccuucgacgacgggaacgacguguggaugggccggaccaucagcgagaagcugcgcuccggguacgagaccuucaaggucaucgagggcuggagcaagcccaacuccaagcuccagaccaaccgccaggugaucguggagcgggggaaccggagcggcuacuccggcaucuucagcgucgaggggaaguccugcaucaaccgcugcuucuacguggagcugauccggggccgcaaggaggagaccgaggugugguggaccagcaacagcaucgucguguucugcgggaccuccggcacguacgggaccggcagcuggccggacggcgccgacaucaaccugaugcccaucuga

SEQ ID NO: 76136 - RNA, 1410 nt, Artificial Sequence; identical to SEQ ID NO: 75162
  derived and/or modified sequence opt1 from neuraminidase__InfluenzaA__ABG37453

SEQ ID NO: 76137 - RNA, 1410 nt, Artificial Sequence; identical to SEQ ID NO: 75174
  derived and/or modified sequence opt1 from neuraminidase__InfluenzaA__ABG37464

SEQ ID NO: 76138 - RNA, 1410 nt, Artificial Sequence
  derived and/or modified sequence opt1 from neuraminidase__InfluenzaA__ABG37475
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcgaccgcagcggguacuccggcaucuucagcgucgagggcaaguccugcaucaaccggugcuucuacguggagcugauccgcgggcggaaggaggagaccgaggugcuguggaccagcaacagcaucgucguguucugcggcaccuccgggaccuacggcacggggagcuggccggacggcgccgacaucaaccucaugcccaucuga

SEQ ID NO: 76139 - RNA, 1410 nt, Artificial Sequence
  derived and/or modified sequence opt1 from neuraminidase__InfluenzaA__ABG37486
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaaccucaccggguucgcccccuucagcaaggacaacuccauccgccugagcgccggcggggacaucugggugacccgggagcccuacguguccugcgaccccgacaagugcuaccaguucgcccugggccaggggaccacgcucaacaacggccacagcaacgacaccguccacgaccgcaccccguaccggacccugcugaugaacgagcucggcgugcccuuccaccuggggacgcgccaggugugcaucgccugguccagcuccagcugccacgacggcaaggcguggcugcacgucugcgugaccggggacgacgagaacgccaccgccuccuucaucuacaacggccggcucguggacagcaucggguccuggagcaagaagauccugcgcacccaggaguccgagugcgucugcaucaacggcacgugcaccguggugaugaccgacggcagcgccuccgggaaggcggacaccaagauccuguucaucgaggagggcaagaucguccacaucagcacgcucagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcuggugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcuccgguccggcuacgagaccuucaaggucaucgagggguggagcaagcccaacuccaagcugcagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccucaugcccaucuga

SEQ ID NO: 76140 - RNA, 1410 nt, Artificial Sequence
  derived and/or modified sequence opt1 from neuraminidase__InfluenzaA__ABG37497
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagaucaucuucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcuggugggcgacacgccccggaagaacgacagcuucuccagcucccacugccucgaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcugcagaccaaccgccaggugaucguggagcggggcaaccgcagcggguacuccggcaucuucagcgucgagggcaaguccugcaucaaccggugcuucuacguggagcucauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76141 - RNA, 1410 nt, Artificial Sequence; identical to SEQ ID NO: 75188
  derived and/or modified sequence opt1 from neuraminidase__InfluenzaA__ABG37508

SEQ ID NO: 76142 - RNA, 1410 nt, Artificial Sequence; identical to SEQ ID NO: 75599
  derived and/or modified sequence opt1 from neuraminidase__InfluenzaA__ABG37519

SEQ ID NO: 76143 - RNA, 1410 nt, Artificial Sequence; identical to SEQ ID NO: 75599
  derived and/or modified sequence opt1 from neuraminidase__InfluenzaA__ABG37530

SEQ ID NO: 76144 - RNA, 1410 nt, Artificial Sequence; identical to SEQ ID NO: 75599
  derived and/or modified sequence opt1 from neuraminidase__InfluenzaA__ABG37541

SEQ ID NO: 76145 - RNA, 1410 nt, Artificial Sequence; identical to SEQ ID NO: 75599
  derived and/or modified sequence opt1 from neuraminidase__InfluenzaA__ABG37552

SEQ ID NO: 76146 - RNA, 1410 nt, Artificial Sequence; identical to SEQ ID NO: 75599
  derived and/or modified sequence opt1 from neuraminidase__InfluenzaA__ABG37563

SEQ ID NO: 76147 - RNA, 1410 nt, Artificial Sequence; identical to SEQ ID NO: 75599
  derived and/or modified sequence opt1 from neuraminidase__InfluenzaA__ABG37585

SEQ ID NO: 76148 - RNA, 1410 nt, Artificial Sequence; identical to SEQ ID NO: 75599
  derived and/or modified sequence opt1 from neuraminidase__InfluenzaA__ABG37596

SEQ ID NO: 76149 - RNA, 1410 nt, Artificial Sequence; identical to SEQ ID NO: 75599
  derived and/or modified sequence opt1 from neuraminidase__InfluenzaA__ABG37607

SEQ ID NO: 76150 - RNA, 1410 nt, Artificial Sequence; identical to SEQ ID NO: 75599
  derived and/or modified sequence opt1 from neuraminidase__InfluenzaA__ABG37618

SEQ ID NO: 76151 - RNA, 1413 nt, Artificial Sequence; identical to SEQ ID NO: 75836
  derived and/or modified sequence opt1 from neuraminidase__InfluenzaA__ABG47810

SEQ ID NO: 76152 - RNA, 1413 nt, Artificial Sequence
  derived and/or modified sequence opt1 from neuraminidase__InfluenzaA__ABG47832
augaaccccaaccagaagaucaucaccaucggcagcaucuccaucgccaucgggaucaucagccugauccuccaggugggcaacaucaucuccaucugggccagccacuccauccagaccgggagccagaaccacacgggcaucugcaaccagcgcaucaucaccuacgagaacuccaccugggucaaccagaccuacgugaacaucaacaacacgaacguggucgcggggaaggacaagaccagcaugacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucacggagaccaucaaguccuggaagaagcgcauccuccggacccaggagagcgagugcgugugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccaacaccggcaccgucaugugcgugugccgcgacaacuggcacgggagcaaccggcccuggguguccuucaaccagaaccuggacuaccagaucggcuacaucugcagcggcgucuucggggacaacccccgcccgaaggacggcgagggguccugcaaccccgugacgguggacggcgcggacggggucaagggcuucagcuaccgguacggcaacgggguguggaucggccgcaccaaguccaaccggcuccgcaagggguucgagaugaucugggaccccaacggcuggaccgacaccgacagcgacuucuccaugaagcaggacaucguggccaugacggacuggagcggguacuccggcagcuucguccagcaccccgagcugaccggccuggacugcaugcggccgugcuucuggguggagcucgugcgcgggcugccccgggagaacaccaccaucuggacgagcggcuccagcaucuccuucugcggggucaacagcgacaccgccaacugguccuggcccgacggcgccgagcugcccuucaccaucgacaaguga

SEQ ID NO: 76153 - RNA, 1413 nt, Artificial Sequence; identical to SEQ ID NO: 75976
  derived and/or modified sequence opt1 from neuraminidase__InfluenzaA__ABG47843

SEQ ID NO: 76154 - RNA, 1410 nt, Artificial Sequence
  derived and/or modified sequence opt1 from neuraminidase__InfluenzaA__ABG47865
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgccugguccagcuccagcugccacgacgggaaggcguggcugcacgugugcgugacgggccacgacgagaacgccaccgccuccuucaucuacgacgggcggcugguggacagcaucggcuccuggagcaagaagauccuccgcacccaggaguccgagugcgucugcaucaacgggaccugcacgguggugaugaccgacggcagcgccuccggccgggcggacaccaagauccuguucaucgaggaggggaagaucguccacaucagcccccugagcggcuccgcccagcacguggaggagugcagcugcuacccccgcuacuccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcugcgcuccggguacgagaccuucaaggucaucggcggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggaccuccaacagcaucgucguguucugcggcacguccgggaccuacggcaccgggagcuggccggacggcgccgacaucaaccugaugcccaucuga

SEQ ID NO: 76155 - RNA, 1410 nt, Artificial Sequence; identical to SEQ ID NO: 76121
  derived and/or modified sequence opt1 from neuraminidase__InfluenzaA__ABG47876

SEQ ID NO: 76156 - RNA, 1410 nt, Artificial Sequence; identical to SEQ ID NO: 76121
  derived and/or modified sequence opt1 from neuraminidase__InfluenzaA__ABG47887

SEQ ID NO: 76157 - RNA, 1410 nt, Artificial Sequence; identical to SEQ ID NO: 76108
  derived and/or modified sequence opt1 from neuraminidase__InfluenzaA__ABG47898

SEQ ID NO: 76158 - RNA, 1410 nt, Artificial Sequence; identical to SEQ ID NO: 76121
  derived and/or modified sequence opt1 from neuraminidase__InfluenzaA__ABG47909

SEQ ID NO: 76159 - RNA, 1410 nt, Artificial Sequence; identical to SEQ ID NO: 76109
  derived and/or modified sequence opt1 from neuraminidase__InfluenzaA__ABG47920

SEQ ID NO: 76160 - RNA, 1410 nt, Artificial Sequence; identical to SEQ ID NO: 76109
  derived and/or modified sequence opt1 from neuraminidase__InfluenzaA__ABG47931

SEQ ID NO: 76161 - RNA, 1410 nt, Artificial Sequence; identical to SEQ ID NO: 76109
  derived and/or modified sequence opt1 from neuraminidase__InfluenzaA__ABG47942

SEQ ID NO: 76162 - RNA, 1410 nt, Artificial Sequence
  derived and/or modified sequence opt1 from neuraminidase__InfluenzaA__ABG47953
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaaccccaacaacgagaagggcagccacggggucaagggcugggccuucgacgacgggaacgacguguggaugggccgcaccaucuccgaggagcugcggagcggcuacgagaccuucaaggucaucgggggcugguccaagccgaacagcaagcugcagaucaaccgccaggugaucguggaccgggggaaccgcuccggcuacagcgggaucuucagcgucgagggcaaguccugcaucaaccggugcuucuacguggagcucauccgcggccgcaagcaggagaccgaggugugguggacgagcaacuccaucgucguguucugcgggaccagcggcaccuacgggaccggcuccuggcccgacggggccaacaucaaccugaugcccaucuga

SEQ ID NO: 76163 - RNA, 1410 nt, Artificial Sequence
  derived and/or modified sequence opt1 from neuraminidase__InfluenzaA__ABG47964
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccagaaccccaacaacgagaagggcucccacggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 76164 - RNA, 1410 nt, Artificial Sequence
  derived and/or modified sequence opt1 from neuraminidase__InfluenzaA__ABG47975
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccgggaccccaacaacgagcgcggcagccacggggucaagggcugggccuucgacgacgggaacgacguguggaugggccggaccaucuccgaggagcugcgcagcggcuacgagaccuucaaggucaucgggggcugguccaagccgaacagcaagcugcagaucaaccgccaggugaucguggaccgggggaaccgguccggcuacagcgggaucuucagcgucgagggcaaguccugcaucaaccgcugcuucuacguggagcucauccgcggccggaagcaggagaccgaggugugguggacgagcaacuccaucgucguguucugcgggaccagcggcaccuacgggaccggcuccuggcccgacggggccgacaucaaccugaugcccaucuga

SEQ ID NO: 76165 - RNA, 1410 nt, Artificial Sequence
  derived and/or modified sequence opt1 from neuraminidase__InfluenzaA__ABG47986
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaagcccaacaacgagaagggcagccacggggucaagggcugggccuucgacgacgggaacgacguguggaugggccgcaccaucuccgaggagcugcggagcggcuacgagaccuucaaggucaucgggggcugguccaagccgaacagcaagcugcagaucaaccgccaggugaucguggaccgggggaaccgcuccggcuacagcgggaucuucagcgucgagggcaaguccugcaucaaccggugcuucuacguggagcucauccgcggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76166 - RNA, 1410 nt, Artificial Sequence; identical to SEQ ID NO: 76109
  derived and/or modified sequence opt1 from neuraminidase__InfluenzaA__ABG47997

SEQ ID NO: 76167 - RNA, 1410 nt, Artificial Sequence
  derived and/or modified sequence opt1 from neuraminidase__InfluenzaA__ABG48008
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgccggaacgacuccagcuccagcuccuacugccgcaagcccaacaacgagaagggcagccacggggucaagggcugggccuucgacgacgggaacgacguguggaugggccggaccaucuccgaggagcugcgcagcggcuacgagaccuucaaggucaucgggggcugguccaagccgaacagcaagcugcagaucaaccgccaggugaucguggaccgggggaaccgguccggcuacagcgggaucuucagcgucgagggcaaguccugcaucaaccgcugcuucuacguggagcucauccgcggccggaagcaggagaccgaggugugguggacgagcaacuccaucgucguguucugcgggaccagcggcaccuacgggaccggcuccuggcccgacggggccgacaucaaccugaugcccaucuga

SEQ ID NO: 76168 - RNA, 1410 nt, Artificial Sequence
  derived and/or modified sequence opt1 from neuraminidase__InfluenzaA__ABG48019
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgccugccgcgacaacuggaagggcagcaaccggcccaucgucgacaucaacgugaaggacuacuccaucgugagcuccuacgucugcagcggccucgugggggacacgccccgcaagaacgacuccagcuccagcuccuacugccggaaccccaacaacgagaagggcagccacggggugaagggcugggccuucgacgacgggaacgacgucuggaugggccgcaccaucuccgaggagcugcggagcggcuacgagaccuucaaggugaucgggggcugguccaagccgaacagcaagcugcagaucaaccgccaggucaucguggaccgggacaaccgcuccggguacagcggcaucuucagcguggaggggaaguccugcaucaaccggugcuucuacgucgagcucauccgcggccgcaagcaggagaccgaggugugguggacgagcaacuccaucguggucuucugcggcaccagcgggaccuacggcaccggguccuggcccgacggcgccgacaucaaccugaugcccaucuga

SEQ ID NO: 76169 - RNA, 1410 nt, Artificial Sequence; identical to SEQ ID NO: 76109
  derived and/or modified sequence opt1 from neuraminidase__InfluenzaA__ABG48030

SEQ ID NO: 76170 - RNA, 1410 nt, Artificial Sequence; identical to SEQ ID NO: 76109
  derived and/or modified sequence opt1 from neuraminidase__InfluenzaA__ABG48041

SEQ ID NO: 76171 - RNA, 1413 nt, Artificial Sequence; identical to SEQ ID NO: 75836
  derived and/or modified sequence opt1 from neuraminidase__InfluenzaA__ABG48052

SEQ ID NO: 76172 - RNA, 1410 nt, Artificial Sequence; identical to SEQ ID NO: 75738
  derived and/or modified sequence opt1 from neuraminidase__InfluenzaA__ABG48063

SEQ ID NO: 76173 - RNA, 1410 nt, Artificial Sequence; identical to SEQ ID NO: 75861
  derived and/or modified sequence opt1 from neuraminidase__InfluenzaA__ABG48074

SEQ ID NO: 76174 - RNA, 1410 nt, Artificial Sequence; identical to SEQ ID NO: 75162
  derived and/or modified sequence opt1 from neuraminidase__InfluenzaA__ABG48085

SEQ ID NO: 76175 - RNA, 1410 nt, Artificial Sequence
  derived and/or modified sequence opt1 from neuraminidase__InfluenzaA__ABG48107
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagacccuccgcacgcaggaguccgagugcgucugcaucaacgggaccugcaccguggugaugaccgacggcagcgccuccgggaaggcggacacgaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76176 - RNA, 1410 nt, Artificial Sequence; identical to SEQ ID NO: 75174
  derived and/or modified sequence opt1 from neuraminidase__InfluenzaA__ABG48118

SEQ ID NO: 76177 - RNA, 1410 nt, Artificial Sequence; identical to SEQ ID NO: 75174
  derived and/or modified sequence opt1 from neuraminidase__InfluenzaA__ABG48129

SEQ ID NO: 76178 - RNA, 1410 nt, Artificial Sequence; identical to SEQ ID NO: 75162
  derived and/or modified sequence opt1 from neuraminidase__InfluenzaA__ABG48140

SEQ ID NO: 76179 - RNA, 1410 nt, Artificial Sequence; identical to SEQ ID NO: 75174
  derived and/or modified sequence opt1 from neuraminidase__InfluenzaA__ABG48151

SEQ ID NO: 76180 - RNA, 1410 nt, Artificial Sequence; identical to SEQ ID NO: 75162
  derived and/or modified sequence opt1 from neuraminidase__InfluenzaA__ABG48173

SEQ ID NO: 76181 - RNA, 1410 nt, Artificial Sequence; identical to SEQ ID NO: 75174
  derived and/or modified sequence opt1 from neuraminidase__InfluenzaA__ABG48184

SEQ ID NO: 76182 - RNA, 1410 nt, Artificial Sequence
  derived and/or modified sequence opt1 from neuraminidase__InfluenzaA__ABG48195
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugcaucgaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcugcagaccaaccgccaggugaucguggagcggggcaaccgcagcggguacuccggcaucuucagcgucgagggcaaguccugcaucaaccggugcuucuacguggagcucauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76183 - RNA, 1410 nt, Artificial Sequence
  derived and/or modified sequence opt1 from neuraminidase__InfluenzaA__ABG48206
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucaacgagaagcugcggagcggcuacgagaccuucaaggugaucgaggggugguccaagcccaacagcaagcuccagaucaaccgccaggugaucgucgagcggggcaaccgcuccggguacagcggcaucuucuccguggagggcaagagcugcaucaaccggugcuucuacguggagcugauccgcgggcggaaggaggagaccgaggucugguggaccuccaacagcaucgugguguucugcggcaccagcgggaccuacggcacgggguccuggccggacggcgccgacaucaaccugaugcccaucuga

SEQ ID NO: 76184 - RNA, 1410 nt, Artificial Sequence; identical to SEQ ID NO: 75599
  derived and/or modified sequence opt1 from neuraminidase__InfluenzaA__ABG48217

SEQ ID NO: 76185 - RNA, 1410 nt, Artificial Sequence; identical to SEQ ID NO: 75599
  derived and/or modified sequence opt1 from neuraminidase__InfluenzaA__ABG48228

SEQ ID NO: 76186 - RNA, 1410 nt, Artificial Sequence; identical to SEQ ID NO: 76183
  derived and/or modified sequence opt1 from neuraminidase__InfluenzaA__ABG48239

SEQ ID NO: 76187 - RNA, 1410 nt, Artificial Sequence; identical to SEQ ID NO: 75599
  derived and/or modified sequence opt1 from neuraminidase__InfluenzaA__ABG48250

SEQ ID NO: 76188 - RNA, 1410 nt, Artificial Sequence
  derived and/or modified sequence opt1 from neuraminidase__InfluenzaA__ABG48272
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 76189 - RNA, 1410 nt, Artificial Sequence
  derived and/or modified sequence opt1 from neuraminidase__InfluenzaA__ABG48294
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugauccccugccagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcuggucccgcaacauccugcggacccaggagagcgagugcgugugcaucaacggcacgugcaccguggucaugaccgacggcuccgccagcgagcgcgccgacaccaagauccucuucaucgaggaggggaagguggugcacaucagcccccuguccggcagcgcgcagcacgucgaggagugcuccugcuacccgcgguaccccggggugcgcugcgugugccgggacaacuggaagggcagcaaccgccccaucgucgacaucaacgugaaggacuacuccaucaucagcuccuacgugugcagcggccuggucggggacacgccccggcgcaacgacuccagcuccagcuccuacugccagaacccgaacaacgagaagggcagccacggggugaagggcugggccuucgacgacgggaacgacgucuggaugggccggaccaucuccgaggagcuccgcagcggcuacgagaccuucaaggugaucgggggcugguccacccccaacagcaagcugcagaucaaccgccaggugaucgucgacuccgggaaccggagcggcuacagcgggaucuucuccguggagggcaagagcugcaucaaccggugcuucuacguggagcugauccgcggccgcaagcaggagacgaaggucugguggaccuccaacagcaucgugguguucugcgggaccuccggcaccuacgggacgggcagcuggcccgacggggccgacaucgaccucaugcccaucuga

SEQ ID NO: 76190 - RNA, 1410 nt, Artificial Sequence
  derived and/or modified sequence opt1 from neuraminidase__InfluenzaA__ABG48305
augaaccccaaccagaagaucaucaucaucggcagcgugucccugaccaucgccaccaucugcuuccucaugcagaucgccauccuggucacgaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccagcuccagcugccacgacggcaaggcguggcugcacgugugcgugacggggcacgacgagaacgccaccgccuccuucaucuacgacggccggcugguggacagcaucggguccuggagcaagaacauccuccgcacccaggaguccgagugcgucugcaucaacgggaccugcacgguggugaugaccgacggcagcgccuccgagcgggcggacaccaagauccuguucaucgaggagggcaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggaccuccaacagcaucgucguguucugcgggacguccggcaccuacgggaccggcagcuggcccgacggggccgacaucaaccugaugcccaucuga

SEQ ID NO: 76191 - RNA, 1410 nt, Artificial Sequence
  derived and/or modified sequence opt1 from neuraminidase__InfluenzaA__ABG48316
augaaccccaaccagaagaucaucaccaucggcagcgugucccugaccgucgccacgaucugcuuccucaugcagaucgccauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcuggucgacagcaucggguccuggagcaagaacauccuccgcacccaggaguccgagugcgugugcaucaacggcacgugcaccguggucaugaccgacggcagcgccuccgagcgggcggacaccaagauccuguucaucgaggaggggaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggagcaagccgaacuccaagcugcagaucaaccgccaggugaucgucgagcgggggaaccgcagcggcuacuccgggaucuucagcguggagggcaagagcugcaucaaccggugcuucuacguggagcucauccgcggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 76192 - RNA, 1410 nt, Artificial Sequence
  derived and/or modified sequence opt1 from neuraminidase__InfluenzaA__ABG48327
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccgcggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccgcggccggaagcaggagaccgaggugugguggacguccaacagcaucgucguguucugcgggaccuccggcaccuacgggaccggcagcuggcccgacggggccgacaucaaccugaugcccaucuga

SEQ ID NO: 76193 - RNA, 1410 nt, Artificial Sequence
  derived and/or modified sequence opt1 from neuraminidase__InfluenzaA__ABG48338
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 76194 - RNA, 1410 nt, Artificial Sequence; identical to SEQ ID NO: 76193
  derived and/or modified sequence opt1 from neuraminidase__InfluenzaA__ABG48349

SEQ ID NO: 76195 - RNA, 1410 nt, Artificial Sequence
  derived and/or modified sequence opt1 from neuraminidase__InfluenzaA__ABG48360
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugauguccgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggcaagcugguggacuccaucgggagcugguccaagaacauccuccggacccaggagagcgagugcgucugcaucaacggcacgugcaccguggugaugaccgacggcuccgccagcgagcgcgcggacaccaagauccuguucaucgaggaggggaagaucguccacaucagcccccuguccggcagcgcccagcacguggaggagugcuccugcuacccccgguacccgggggugcgcugcgucugccgggacaacuggaagggcagcaaccgccccaucguggacaucaacgugaaggaccacuccaucgucagcuccuacgugugcagcggccucgugggggacacgccccggaagaacgacuccagcuccagcuccuacugccgcaaccccaacaacgagaagggcagccacggggucaagggcugggccuucgacgacgggaacgacguguggaugggccggaccaucuccgaggagcugcgcagcggcuacgagaccuucaaggucaucgggggcugguccaagccgaacagcaagcugcagaucaaccgccaggugaucguggaccgggggaaccgguccggcuacagcgggaucuucagcgucgagggcaaguccugcaucaaccgcugcuucuacguggagcucauccggggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76196 - RNA, 1410 nt, Artificial Sequence; identical to SEQ ID NO: 76193
  derived and/or modified sequence opt1 from neuraminidase__InfluenzaA__ABG48371

SEQ ID NO: 76197 - RNA, 1410 nt, Artificial Sequence
  derived and/or modified sequence opt1 from neuraminidase__InfluenzaA__ABG67138
augaaccccaaccagaagaucaucaccaucggcagcgugucccugaccaucgccacgaucugcuuccucacccagaucgccauccuggucaccaccgugacgcugcacuucaagcaguacgagugcaacagcccgcccuccaaccaggugaugcucugcgagcccaccaccaucgagcgcaacaucaccgagaucgucuaccugacgaacaccaccaucgagaaggagaucugccccaagcuggcggaguaccggaacuggagcaagccgcagugcaagaucaccggguucgcccccuucuccaaggacaacagcauccgccucuccgccggcggggacaucugggugacgcgggagcccuacgugagcugcgaccccgacaagugcuaccaguucgcccugggccaggggaccacccugaacaaccgccacuccaacgacaccguccacgaccggacgccguaccgcacccuccugaugaacgagcugggcgugcccuuccaccucggcaccaagcaggucugcaucgccuggagcuccagcuccugccacgacgggaaggcguggcugcacgugugcgugaccggccacgacgagaacgccacggccagcuucaucuacgacgggcggcugguggacuccaucggcagcugguccaagaagauccuccgcacccaggagagcgagugcgucugcaucaacgggaccugcaccguggugaugacggacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcugcgcuccggguacgagaccuucaaggucaucgagggcuggagcaagccgaacuccaagcuccagaucaaccgccaggugaucguggaccgggggaaccggagcggcuacuccgggaucuucagcgucgagggcaagagcugcaucaaccgcugcuucuacguggagcugauccggggccgcaagcaggagaccgaggugugguggaccuccaacagcaucgucguguucugcgggaccuccggcacguacgggaccggcagcuggcccgacggggccgacaucaaccugaugcccaucuga

SEQ ID NO: 76198 - RNA, 1410 nt, Artificial Sequence; identical to SEQ ID NO: 75134
  derived and/or modified sequence opt1 from neuraminidase__InfluenzaA__ABG67149

SEQ ID NO: 76199 - RNA, 1410 nt, Artificial Sequence
  derived and/or modified sequence opt1 from neuraminidase__InfluenzaA__ABG67160
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccgguccuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcgugaacggcacgugcaccguggucaugaccgacggcuccgccagcgagcgggcggacaccaagauccuguucaucgaggaggggaagaucgugcacaucagcccccuguccggcagcgcccagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcuccuacugcuggaaccccaacaacgagaagggcgggcacggcgugaaggggugggccuucgacgacggcaacgacgucuggaugggccggaccaucagcgaggagcugcgcuccggguacgagaccuucaaggugaucggcggguggagcaagccgaacuccaagcugcagaucaaccgccaggugaucgucgaccggggcaaccggagcggguacuccggcaucuucagcguggagggcaagagcugcaucaaccgcugcuucuacguggagcucauccgggggcgcaagcaggagaccgaggucugguggacguccaacagcaucgugguguucugcggcaccuccgggaccuacggcaccgggagcuggcccgacggcgccgacaucaaccugaugcccaucuga

SEQ ID NO: 76200 - RNA, 1410 nt, Artificial Sequence
  derived and/or modified sequence opt1 from neuraminidase__InfluenzaA__ABG67171
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacaagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggagcaagccgaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggacguccaacagcaucgucguguucugcggcaccuccgggaccuacggcaccgggagcuggcccgacggcgccgacaucaaccucaugcccaucuga

SEQ ID NO: 76201 - RNA, 1410 nt, Artificial Sequence; identical to SEQ ID NO: 76121
  derived and/or modified sequence opt1 from neuraminidase__InfluenzaA__ABG67182

SEQ ID NO: 76202 - RNA, 1410 nt, Artificial Sequence
  derived and/or modified sequence opt1 from neuraminidase__InfluenzaA__ABG67193
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaccaucgagcgcaacaucaccgagaucgucuaccugaccaacacgaccaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcacgacccugaacaaccgccacagcaacgacaccguccacgaccggaccccguaccgcacgcuccugaugaacgagcugggcgugcccuuccaccucgggaccaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacgcaggaguccgagugcgucugcaucaacgggaccugcaccguggugaugaccgacggcagcgccuccgaccgggcggacacgaagauccuguucaucgaggagggcaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaagaacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggagcaagccgaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggaccuccaacagcaucgucguguucugcggcaccuccgggaccuacggcacggggagcuggcccgacggcgccgacaucaaccucaugcccaucuga

SEQ ID NO: 76203 - RNA, 1410 nt, Artificial Sequence; identical to SEQ ID NO: 76121
  derived and/or modified sequence opt1 from neuraminidase__InfluenzaA__ABG67204

SEQ ID NO: 76204 - RNA, 1410 nt, Artificial Sequence
  derived and/or modified sequence opt1 from neuraminidase__InfluenzaA__ABG67215
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcggccccgggaagugcuaccaguucgcccugggccagggcaccacgcugaacaaccgccacuccaacgacaccguccacgaccggaccccguaccgcacccuccugaugaacgagcugggggugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaacauccuccgcacccaggagagcgagugcgucugcaucaacggcacgugcaccguggugaugaccgacggguccgccagcgagcgggcggacaccaagauccuguucaucgaggagggcaagaucguccacaucagcccccuguccgggagcgcccagcacguggaggagugcuccugcuacccccgcuacccgggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugccggaaccccaacaacgagaaggggagccacggcgucaaggggugggccuucgacgacggcaacgacguguggaugggccgcaccaucuccgaggagcugcggagcggguacgagaccuucaaggucaucggcgggugguccaagccgaacagcaagcugcagaucaaccgccaggugaucguggaccggggcaaccgcuccggguacagcggcaucuucagcgucgagggcaaguccugcaucaaccggugcuucuacguggagcucauccgcgggcgcaagcaggagaccgaggugugguggacgagcaacuccaucgucguguucugcggcaccagcgggaccuacggcaccggguccuggcccgacggcgccgacaucaaccugaugcccaucuga

SEQ ID NO: 76205 - RNA, 1410 nt, Artificial Sequence; identical to SEQ ID NO: 76109
  derived and/or modified sequence opt1 from neuraminidase__InfluenzaA__ABG67226

SEQ ID NO: 76206 - RNA, 1410 nt, Artificial Sequence; identical to SEQ ID NO: 76109
  derived and/or modified sequence opt1 from neuraminidase__InfluenzaA__ABG67248

SEQ ID NO: 76207 - RNA, 1413 nt, Artificial Sequence; identical to SEQ ID NO: 75836
  derived and/or modified sequence opt1 from neuraminidase__InfluenzaA__ABG67480

SEQ ID NO: 76208 - RNA, 1413 nt, Artificial Sequence; identical to SEQ ID NO: 75404
  derived and/or modified sequence opt1 from neuraminidase__InfluenzaA__ABG67494

SEQ ID NO: 76209 - RNA, 1410 nt, Artificial Sequence; identical to SEQ ID NO: 75162
  derived and/or modified sequence opt1 from neuraminidase__InfluenzaA__ABG67505

SEQ ID NO: 76210 - RNA, 1410 nt, Artificial Sequence; identical to SEQ ID NO: 75162
  derived and/or modified sequence opt1 from neuraminidase__InfluenzaA__ABG67516

SEQ ID NO: 76211 - RNA, 1410 nt, Artificial Sequence; identical to SEQ ID NO: 76175
  derived and/or modified sequence opt1 from neuraminidase__InfluenzaA__ABG67527

SEQ ID NO: 76212 - RNA, 1410 nt, Artificial Sequence
  derived and/or modified sequence opt1 from neuraminidase__InfluenzaA__ABG67538
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaccaucgagcgcaacaccaccgagaucgucuaccugacgaacaccaccaucgagaaggagaucugccccaagcuggcggaguaccggaacugguccaagccgcagugcaacaucaccggguucgcccccuucagcaaggacaacuccauccgccucagcgccggcggggacaucugggugacgcgggagcccuacguguccugcgaccccgacaagugcuaccaguucgcccugggccaggggaccacccugaacaacggccacagcaacgacaccguccacgaccgcacgccguaccggacccuccugaugaacgagcugggcgugcccuuccaccucgggacccgccaggugugcaucgccugguccagcuccagcugccacgacggcaaggcguggcugcacgucugcgugaccggggacgacgagaacgccacggccuccuucaucuacaacggccggcugguggacagcaucggguccuggagcaagaagauccuccgcacccaggaguccgagugcgucugcaucaacgggaccugcaccguggugaugacggacggcagcgccuccgggaaggcggacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucaucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaccaaccgccaggucaucguggagcggggcaaccgcagcggguacuccggcaucuucagcguggagggcaaguccugcaucaaccggugcuucuacgucgagcugauccgcgggcggaaggaggagaccgaggugugguggacgagcaacagcaucguggucuucugcggcaccuccgggaccuacggcaccgggagcuggccggacggcgccgacaucaaccugaugcccaucuga

SEQ ID NO: 76213 - RNA, 1410 nt, Artificial Sequence
  derived and/or modified sequence opt1 from neuraminidase__InfluenzaA__ABG67549
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaacgaggucugguggaccagcaacagcaucgugguguucugcggcaccuccgggaccuacggcaccgggagcuggccggacggcgccgacaucaaccugaugcccaucuga

SEQ ID NO: 76214 - RNA, 1410 nt, Artificial Sequence; identical to SEQ ID NO: 75599
  derived and/or modified sequence opt1 from neuraminidase__InfluenzaA__ABG67560

SEQ ID NO: 76215 - RNA, 1410 nt, Artificial Sequence; identical to SEQ ID NO: 75599
  derived and/or modified sequence opt1 from neuraminidase__InfluenzaA__ABG67571

SEQ ID NO: 76216 - RNA, 1410 nt, Artificial Sequence
  derived and/or modified sequence opt1 from neuraminidase__InfluenzaA__ABG67582
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgaagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 76217 - RNA, 1410 nt, Artificial Sequence; identical to SEQ ID NO: 76183
  derived and/or modified sequence opt1 from neuraminidase__InfluenzaA__ABG67593

SEQ ID NO: 76218 - RNA, 1410 nt, Artificial Sequence; identical to SEQ ID NO: 75599
  derived and/or modified sequence opt1 from neuraminidase__InfluenzaA__ABG67604

SEQ ID NO: 76219 - RNA, 1410 nt, Artificial Sequence; identical to SEQ ID NO: 75599
  derived and/or modified sequence opt1 from neuraminidase__InfluenzaA__ABG67615

SEQ ID NO: 76220 - RNA, 1410 nt, Artificial Sequence; identical to SEQ ID NO: 75599
  derived and/or modified sequence opt1 from neuraminidase__InfluenzaA__ABG67626

SEQ ID NO: 76221 - RNA, 1410 nt, Artificial Sequence; identical to SEQ ID NO: 75599
  derived and/or modified sequence opt1 from neuraminidase__InfluenzaA__ABG67637

SEQ ID NO: 76222 - RNA, 1410 nt, Artificial Sequence; identical to SEQ ID NO: 75599
  derived and/or modified sequence opt1 from neuraminidase__InfluenzaA__ABG67648

SEQ ID NO: 76223 - RNA, 1410 nt, Artificial Sequence
  derived and/or modified sequence opt1 from neuraminidase__InfluenzaA__ABG67659
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagccgcgacaacuccauccggcucagcgccggcggggacaucugggugacccgcgagcccuacgucuccugcgaccccgacaagugcuaccaguucgcccugggccaggggaccacgcugaacaacggccacagcaacgacaccgugcacgaccggaccccguaccgcacccuccugaugaacgagcugggcgugcccuuccaccucgggacgcggcaggucugcaucgccugguccagcuccagcugccacgacggcaaggccuggcugcacgugugcgugaccggggacgacaagaacgcgaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcucgucggcgacacgccccgcaagaacgacagcuucuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccgccaggugaucgucgagcggggcaaccggagcggguacuccggcaucuucagcguggagggcaaguccugcaucaaccgcugcuucuacguggagcugauccgggggcgcaaggaggagaccgaggucugguggaccagcaacagcaucgugguguucugcggcaccuccgggaccuacggcacggggagcuggccggacggcgccgacaucaaccugaugcccaucuga

SEQ ID NO: 76224 - RNA, 1410 nt, Artificial Sequence
  derived and/or modified sequence opt1 from neuraminidase__InfluenzaA__ABG67670
augaaccccaaccagaagaucaucaccaucggcagcgugucccugaccaucgccacgaucugcuuccucaugcagaucgccauccugaucaccaccgucacccugcacuucaagcaguacgagugcaacagcccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgccuccgggcgggcggacaccaagauccuguucaucgaggagggcaagaucgugcacaucagcccccugagcggguccgcccagcacgucgaggagugcagcugcuacccccgcuacccgggcgugcggugcgugugccgcgacaacuggaagggcuccaaccggcccaucgucgacaucaacgugaaggacuacagcaucguguccagcuacgucugcuccgggcucgugggcgacacgccccgcaagaacgacagcuccagcuccagccacugccugaaccccaacaacgaggagggcgggcacggggugaagggcugggccuucgacgacggcaacgacgucuggauggggcggaccaucuccgagaagcugcgcagcggcuacgagaccuucaaggugaucgggggcugguccaagccgaacagcaagcuccagaucaaccggcaggucaucguggaccgcgggaaccgguccggcuacagcggcaucuucuccguggagggcaagagcugcaucaaccgcugcuucuacgucgagcugauccgggggcgcaagcaggagaccgaggugugguggacgagcaacuccaucguggucuucugcgggaccagcggcaccuacgggaccggcuccuggcccgacggcgccgacaucaaccugaugcccaucuga

SEQ ID NO: 76225 - RNA, 1410 nt, Artificial Sequence; identical to SEQ ID NO: 75738
  derived and/or modified sequence opt1 from neuraminidase__InfluenzaA__ABG79944

SEQ ID NO: 76226 - RNA, 1413 nt, Artificial Sequence; identical to SEQ ID NO: 76067
  derived and/or modified sequence opt1 from neuraminidase__InfluenzaA__ABG79955

SEQ ID NO: 76227 - RNA, 1410 nt, Artificial Sequence
  derived and/or modified sequence opt1 from neuraminidase__InfluenzaA__ABG79966
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccagaaccccaacaacgagaagggcagccacggggucaagggcugggccuucgacgacgggaacgacguguggaugggccggaccaucuccgaggagcugcgcagcggcuacgagaccuucaaggucaucgggggcugguccaagccgaacagcaagcugcagaucaaccgccaggugaucguggaccgggggaaccgguccggcuacagcgggaucuucagcgucgagggcaaguccugcaucaaccgcugcuucuacguggagcucauccggggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76228 - RNA, 1410 nt, Artificial Sequence
  derived and/or modified sequence opt1 from neuraminidase__InfluenzaA__ABG79977
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgcgugguccagcuccagcugccacgacggcaaggccuggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgcguccgaccgggccgacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggagcaagccgaacuccaagcugcagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugugguggacguccaacagcaucguggucuucugcggcaccuccgggaccuacggcaccgggagcuggcccgacggcgccgacaucaaccucaugcccaucuga

SEQ ID NO: 76229 - RNA, 1410 nt, Artificial Sequence; identical to SEQ ID NO: 76121
  derived and/or modified sequence opt1 from neuraminidase__InfluenzaA__ABG79988

SEQ ID NO: 76230 - RNA, 1410 nt, Artificial Sequence; identical to SEQ ID NO: 76121
  derived and/or modified sequence opt1 from neuraminidase__InfluenzaA__ABG79999

SEQ ID NO: 76231 - RNA, 1410 nt, Artificial Sequence
  derived and/or modified sequence opt1 from neuraminidase__InfluenzaA__ABG80010
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggaagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggagcaagccgaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggacguccaacagcaucgucguguucugcggcaccuccgggaccuacggcaccgggagcuggcccgacggcgccgacaucaaccucaugcccaucuga

SEQ ID NO: 76232 - RNA, 1410 nt, Artificial Sequence; identical to SEQ ID NO: 76121
  derived and/or modified sequence opt1 from neuraminidase__InfluenzaA__ABG80021

SEQ ID NO: 76233 - RNA, 1410 nt, Artificial Sequence
  derived and/or modified sequence opt1 from neuraminidase__InfluenzaA__ABG80032
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccaucaucuacgacggccggcugguggacagcaucuccagcugguccaagaacauccuccgcacccaggagagcgagugcgucugcaucaacgggacgugcaccguggugaugaccgacggcuccgccagcgagcgggcggacaccaagauccuguucaucgaggagggcaagaucguccacaucagcccccuguccgggagcgcccagcacguggaggagugcuccugcuacccccgcuacccgggcgugcggugcgucugccgcgacaacuggaaggggagcaaccggcccaucguggacaucaacgugaaggacuacuccaucgucagcuccuacgugugcagcggccucgugggcgacacgccccgcaagaacgacuccagcuccagcuccuacugccugaaccccaacaacgaggagggcgggcacggggucaagggcugggccuucgacgacgggaacgacguguggaugggccggaccaucagcgagaagcugcgcuccggcuacgagaccuucaaggucaucgggggcuggagcaagccgaacuccaagcuccagaucaaccgccaggugaucguggaccgggggaaccggagcggcuacuccgggaucuucagcgucgagggcaagagcugcgugaaccgcugcuucuacguggagcugauccggggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 76234 - RNA, 1410 nt, Artificial Sequence; identical to SEQ ID NO: 76108
  derived and/or modified sequence opt1 from neuraminidase__InfluenzaA__ABG80043

SEQ ID NO: 76235 - RNA, 1410 nt, Artificial Sequence; identical to SEQ ID NO: 76121
  derived and/or modified sequence opt1 from neuraminidase__InfluenzaA__ABG80054

SEQ ID NO: 76236 - RNA, 1410 nt, Artificial Sequence; identical to SEQ ID NO: 76108
  derived and/or modified sequence opt1 from neuraminidase__InfluenzaA__ABG80065

SEQ ID NO: 76237 - RNA, 1410 nt, Artificial Sequence
  derived and/or modified sequence opt1 from neuraminidase__InfluenzaA__ABG80076
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagaacugcaucaaccggugcuucuacguggagcucauccgcggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76238 - RNA, 1410 nt, Artificial Sequence
  derived and/or modified sequence opt1 from neuraminidase__InfluenzaA__ABG80087
augaaccccaaccagaagaucaucaccaucggcagcgugucccugaccaucgccacgaucugcuuccucaugcagaucgccguccuggugaccaccgugacccugcacuucaagcaguacgagugcaacagcccgcccuccaaccaggucaugcucugcgagcccacgaucaucgagcgcaacaucaccgagaucguguaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgucagcugcgaccccggcaagugcuaccaguucgcccuggggcagggcaccacgcugaacaaccgccacuccaacgacaccgugcacgaccggaccccguaccgcacccuccugaugaacgagcugggcgugcccuuccaccucgggacgaagcaggucugcauggccuggagcuccagcuccugccacgacggcaaggcguggcugcacgugugcgugaccgggcacgacgagaacgccaccgccagcuucaucuacgacggccggcuggucgacuccaucgggagcugguccaagaacauccuccgcacccaggagagcgagugcgugugcaucaacggcacgugcaccguggucaugaccgacggcuccgccagcgagcgggcggacaccaagauccuguucaucgaggaggggaagaucgugcacaucagcccccuguccggcagcgcccagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcuccuacugccggaaccccaacaacgagaagggcagccacggggugaagggcugggccuucgacgacgggaacgacgucuggaugggccgcaccaucuccgaggagcugcggagcggcuacgagaccuucaaggugaucgggggcugguccaagccgaacagcaagcugcagaucaaccgccaggugaucgucgaccgggggaaccgcuccggcuacagcgggaucuucagcguggagggcaaguccugcaucaaccggugcuucuacguggagcucauccgcggccgcaagcaggagaccgaggucugguggacgagcaacuccaucgugguguucugcgggaccagcggcaccuacgggaccggcuccuggcccgacggggccgacaucaaccugaugcccaucuga

SEQ ID NO: 76239 - RNA, 1410 nt, Artificial Sequence; identical to SEQ ID NO: 76165
  derived and/or modified sequence opt1 from neuraminidase__InfluenzaA__ABG80098

SEQ ID NO: 76240 - RNA, 1410 nt, Artificial Sequence; identical to SEQ ID NO: 76109
  derived and/or modified sequence opt1 from neuraminidase__InfluenzaA__ABG80109

SEQ ID NO: 76241 - RNA, 1410 nt, Artificial Sequence
  derived and/or modified sequence opt1 from neuraminidase__InfluenzaA__ABG80120
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcaucugcaucaacggcacgugcaccgucgugaugaccgacggcuccgccagcgagcgggcggacaccaagauccuguucaucgaggaggggaagaucgugcacaucagcccccuguccggcagcgcccagcacgucgaggagugcuccugcuacccccgcuacccgggggugcggugcgugugccgcgacaacuggaagggcagcaaccggcccaucgucgacaucaacgugaaggacuacuccaucgugagcuccuacgucugcagcggccucgugggggacacgccccgcaagaacgacuccagcuccagcuccuacugccggaaccccaacaacgagaagggcagccacggggugaagggcugggccuucgacgacgggaacgacgucuggaugggccgcaccaucuccgaggagcugcggagcggcuacgagaccuucaaggugaucgggggcugguccaagccgaacagcaagcugcagaucaaccgccaggucaucguggaccgggggaaccgcuccggcuacagcgggaucuucagcguggagggcaaguccugcaucaaccggugcuucuacgucgagcucauccgcggccgcaagcaggagaccgaggugugguggacgagcaacuccaucguggucuucugcgggaccagcggcaccuacgggaccggcuccuggcccgacggggccgacaucaaccugaugcccaucuga

SEQ ID NO: 76242 - RNA, 1410 nt, Artificial Sequence
  derived and/or modified sequence opt1 from neuraminidase__InfluenzaA__ABG80131
augaaccccaaccagaagaucaucaccaucggcagcgugucccugaccaucgccacgaucugcuuccucaugcagaucgccaucauggucaccaccgugacccugcacuucaagcaguacgagugcaacagcccgcccuccaaccaggugaugcugugcgagcccacgaucaucgagcgcaacaucaccgagaucgucuaccucaccaacaccacgaucgagaaggagaucugccccaagcuggcggaguaccggaacuggagcaagccgcagugcaagaucaccggguucgcccccuucuccaaggacaacagcauccgccuguccgccggcggggacaucugggugacccgggagcccuacgugagcugcgaccccggcaagugcuaccaguucgcccucgggcagggcaccacgcugaacaaccgccacuccaacgacaccguccacgaccggaccccguaccgcacccugcucaugaacgagcugggcgugcccuuccaccuggggacgaagcaggucugcaucgccuggagcuccagcuccugccacgacggcaaggcguggcuccacgugugcgugaccgggcacgacgagaacgccaccgccagcuucaucuacgacggccggcugguggacuccaucgggagcugguccaagaacauccugcgcacccaggagagcgagugcgucugcaucaacggcacgugcaccguggugaugaccgacggcuccgccagcgagcgggcggacaccaagauccucuucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcuccuacugccggaaccccaacaacgagaagggcagccacggggucaagggcugggccuucgacgacgggaacgacguguggaugggccgcaccaucuccgaggagcuccggagcggcuacgagaccuucaaggucaucgggggcugguccaagccgaacagcaagcugcagaucaaccgccaggugaucguggaccgggggaaccgcuccggcuacagcgggaucuucagcgucgagggcaaguccugcaucaaccggugcuucuacguggagcugauccgcggccgcaagcaggagaccgaggugugguggacgagcaacuccaucgucguguucugcgggaccagcggcaccuacgggaccggcuccuggcccgacggggccgacaucaaccucaugcccaucuga

SEQ ID NO: 76243 - RNA, 1410 nt, Artificial Sequence; identical to SEQ ID NO: 76109
  derived and/or modified sequence opt1 from neuraminidase__InfluenzaA__ABG80142

SEQ ID NO: 76244 - RNA, 1410 nt, Artificial Sequence; identical to SEQ ID NO: 76165
  derived and/or modified sequence opt1 from neuraminidase__InfluenzaA__ABG80153

SEQ ID NO: 76245 - RNA, 1410 nt, Artificial Sequence; identical to SEQ ID NO: 76109
  derived and/or modified sequence opt1 from neuraminidase__InfluenzaA__ABG80164

SEQ ID NO: 76246 - RNA, 1413 nt, Artificial Sequence; identical to SEQ ID NO: 75836
  derived and/or modified sequence opt1 from neuraminidase__InfluenzaA__ABG80186

SEQ ID NO: 76247 - RNA, 1410 nt, Artificial Sequence; identical to SEQ ID NO: 75069
  derived and/or modified sequence opt1 from neuraminidase__InfluenzaA__ABG80197

SEQ ID NO: 76248 - RNA, 1410 nt, Artificial Sequence; identical to SEQ ID NO: 75261
  derived and/or modified sequence opt1 from neuraminidase__InfluenzaA__ABG80219

SEQ ID NO: 76249 - RNA, 1410 nt, Artificial Sequence
  derived and/or modified sequence opt1 from neuraminidase__InfluenzaA__ABG80230
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaacauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcgaguccgcccagcacguggaggagugcagcugcuacccccgguaccccggggugcgcugcgucugccgggacaacuggaagggcuccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaaggggugggccuucgacgacggcaacgacguguggaugggccgcaccaucagcgagaagcugcgguccggguacgagaccuucaaggucaucgagggcuggagcaagcccaacuccaagcuccagaccaaccgccaggugaucguggagcgggggaaccgcagcggcuacuccgggaucuucagcgucgagggcaaguccugcaucaaccggugcuucuacguggagcugauccgcggccggaaggaggagaccgaggugugguggaccagcaacagcaucgucguguucugcgggaccuccggcacguacgggaccggcagcuggccggacggggccgacaucaaccugaugcccaucuga

SEQ ID NO: 76250 - RNA, 1410 nt, Artificial Sequence; identical to SEQ ID NO: 75599
  derived and/or modified sequence opt1 from neuraminidase__InfluenzaA__ABG80241

SEQ ID NO: 76251 - RNA, 1410 nt, Artificial Sequence; identical to SEQ ID NO: 75599
  derived and/or modified sequence opt1 from neuraminidase__InfluenzaA__ABG80252

SEQ ID NO: 76252 - RNA, 1410 nt, Artificial Sequence; identical to SEQ ID NO: 76183
  derived and/or modified sequence opt1 from neuraminidase__InfluenzaA__ABG80263

SEQ ID NO: 76253 - RNA, 1410 nt, Artificial Sequence; identical to SEQ ID NO: 75744
  derived and/or modified sequence opt1 from neuraminidase__InfluenzaA__ABG80274

SEQ ID NO: 76254 - RNA, 1410 nt, Artificial Sequence; identical to SEQ ID NO: 75335
  derived and/or modified sequence opt1 from neuraminidase__InfluenzaA__ABG80285

SEQ ID NO: 76255 - RNA, 1410 nt, Artificial Sequence; identical to SEQ ID NO: 75335
  derived and/or modified sequence opt1 from neuraminidase__InfluenzaA__ABG80296

SEQ ID NO: 76256 - RNA, 1410 nt, Artificial Sequence; identical to SEQ ID NO: 75335
  derived and/or modified sequence opt1 from neuraminidase__InfluenzaA__ABG80307

SEQ ID NO: 76257 - RNA, 1410 nt, Artificial Sequence; identical to SEQ ID NO: 75722
  derived and/or modified sequence opt1 from neuraminidase__InfluenzaA__ABG80318

SEQ ID NO: 76258 - RNA, 1410 nt, Artificial Sequence; identical to SEQ ID NO: 75335
  derived and/or modified sequence opt1 from neuraminidase__InfluenzaA__ABG80329

SEQ ID NO: 76259 - RNA, 1410 nt, Artificial Sequence; identical to SEQ ID NO: 75335
  derived and/or modified sequence opt1 from neuraminidase__InfluenzaA__ABG80340

SEQ ID NO: 76260 - RNA, 1410 nt, Artificial Sequence; identical to SEQ ID NO: 76193
  derived and/or modified sequence opt1 from neuraminidase__InfluenzaA__ABG80351

SEQ ID NO: 76261 - RNA, 1410 nt, Artificial Sequence
  derived and/or modified sequence opt1 from neuraminidase__InfluenzaA__ABG80373
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggaccacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 76262 - RNA, 1410 nt, Artificial Sequence; identical to SEQ ID NO: 76261
  derived and/or modified sequence opt1 from neuraminidase__InfluenzaA__ABG80384

SEQ ID NO: 76263 - RNA, 1410 nt, Artificial Sequence
  derived and/or modified sequence opt1 from neuraminidase__InfluenzaA__ABG80395
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccaagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaacaugagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 76264 - RNA, 1410 nt, Artificial Sequence; identical to SEQ ID NO: 76193
  derived and/or modified sequence opt1 from neuraminidase__InfluenzaA__ABG80406

SEQ ID NO: 76265 - RNA, 1410 nt, Artificial Sequence; identical to SEQ ID NO: 76193
  derived and/or modified sequence opt1 from neuraminidase__InfluenzaA__ABG80417

SEQ ID NO: 76266 - RNA, 1410 nt, Artificial Sequence; identical to SEQ ID NO: 76193
  derived and/or modified sequence opt1 from neuraminidase__InfluenzaA__ABG80428

SEQ ID NO: 76267 - RNA, 1410 nt, Artificial Sequence; identical to SEQ ID NO: 75134
  derived and/or modified sequence opt1 from neuraminidase__InfluenzaA__ABG88292

SEQ ID NO: 76268 - RNA, 1413 nt, Artificial Sequence; identical to SEQ ID NO: 76058
  derived and/or modified sequence opt1 from neuraminidase__InfluenzaA__ABG88314

SEQ ID NO: 76269 - RNA, 1413 nt, Artificial Sequence
  derived and/or modified sequence opt1 from neuraminidase__InfluenzaA__ABG88325
augaaccccaaccagaagaucaucaccaucggcagcaccuccaucgccaucgggaucaucagccugauccuccagaucggcaacaucaucuccaucugggccagccacuccauccagacggggagccagaaccacaccggcaucugcaaccagcgcaucaucaccuacgagaacuccaccugggugaaccagacguacgucaacaucaacaacaccagcgugguggcggggaaggacaagaccuccaugacccuggccggcaacagcucccugugcccgauccggggcugggccaucuacacgaaggacaacagcauccgcaucggguccaagggcgacgucuucgugauccgggagcccuucaucagcugcucccaccucgagugccgcaccuucuuccugacccagggggcccugcucaacgacaagcacagcaacggcaccgugaaggaccggucccccuaccgcgcccugaugagcugcccccugggggaggcgccgucccccuacaacagccgguucgagagcgucgccugguccgccagcgccugccacgacggccucggcuggcugacgaucgggaucuccggccccgacaacggggcgguggccgugcugaaguacaacggcaucaucaccgagaccaucaagagcuggaagaagcgcauccuccggacccaggaguccgagugcgucugcaugaacggcagcugcuucacgaucaugaccgacgggcccuccaacggcgccgccagcuaccgcaucuucaagaucgagaaggggcgggugaccaaguccaucgagcuggacgccccgaacuaccacuacgaggagugcagcugcuaccccgacaccggcacggugaugugcgucugccgcgacaacuggcacggguccaaccggcccugggugagcuucaaccagaaccuggacuaccagaccggcuacaucugcuccggcguguucggggacaacccccgcccgaaggacggcgaggggagcugcaaccccgucaccgcggacggcgccgacggggugaagggcuucuccuaccgguacggcaacgggguguggaucggccgcaccaagagcaaccggcuccgcaagggguucgagaugaucugggaccccaacggcuggacggacaccgacuccgacuucagcaugaagcaggacaucgucgccaugaccgacugguccggguacagcggcagcuucgugcagcaccccgagcugaccggccuggacugcaugcggccgugcuucuggguggagcucguccgcgggcugccccgggagaacacgaccaucuggaccuccggcagcuccaucagcuucugcggggugaacuccgacaccgccaacuggagcuggcccgacggcgccgagcugcccuucacgaucgacaaguga

SEQ ID NO: 76270 - RNA, 1413 nt, Artificial Sequence
  derived and/or modified sequence opt1 from neuraminidase__InfluenzaA__ABG88336
augaaccccaaccagaagaucaucaccaucggcagcaucugcauggccaucgggaucaucucccugauccuccagaucggcaacaucaucagcaucugggugucccacagcauccagaccgggaaccagaaccacacgggcaucugcaaccagcgcaucaucaccuacgagaacuccaccugggucaaccagaccuacgugaacaucaacaacacgaacguggucgccgggaaggacaccaccagcgugacccuggcgggcaacuccagccugugcccggugcggggcugggccaucuacuccaaggacaacagcauccgcaucggguccaagggcgacgucuucgugauccgggagcccuucaucagcugcucccaccucgagugccgcacguucuuccugacccagggggcccugcucaacgacaagcacagcaacggcaccgugaaggaccggucccccuaccgcgcccugaugagcugccccaucggggaggccccgucccccuacaacagccgguucgaguccgucgcguggagcgccagcgccugccacgacggcaugggcuggcugaccaucgggaucuccggccccgacgacggggccguggcggugcucaaguacaacggcaucaucacggagaccaucaagagcuggcgcaagcggauccugcgcacccaggaguccgagugcgucugcgugaacggcagcugcuucaccaucaugacggacgggcccuccaacggcccggccagcuacaagaucuucaagaucgagaaggggaagaucaccaaguccaucgagcuggacgcccccaacagccacuacgaggagugcuccugcuaccccgacaccggcaccgugaugugcgucugccgggacaacuggcacgggagcaaccgccccuggguguccuucaaccagaaccucgacuaccagcugggcuacaucugcagcggcaucuucggggacaacccgcggcccaaggacggcaagggguccugcggccccgugacggucgacggggccgacggcgugaagggcuucagcuaccgcuacgggaacggcguguggaucgggcggaccaaguccaacagcucccgcaagggcuucgagaugaucugggaccccaacggguggaccgacaccgacagcaacuuccuggucaagcaggacgugguggccaugacggacugguccggcuacagcggcagcuucguccagcacccggagcucaccgggcuggacugcaugcggcccugcuucuggguggagcugauccgcggccggccccgcgagaccaccacgaucuggaccuccgggagcuccaucagcuucugcggcgucaacuccgacaccgugaacuggagcuggcccgacggcgcggagcucccguucaccaucgacaaguga

SEQ ID NO: 76271 - RNA, 1413 nt, Artificial Sequence
  derived and/or modified sequence opt1 from neuraminidase__InfluenzaA__ABG88347
augaaccccaaccagaagaucaucaccaucggcagcaucugcauggccaucgggaucaucggccugauccuccagaucgggaacaucaucuccaucugggugagccacuccauccagaccggcagccagaaccacacggggaucugcaaccagcgcaucaucaccuacgagaacuccaccugggucaaccagaccuacgugaacaucaacaacacgaacguggucgccggcaaggacaccaccagcgugacccuggcgggcaacuccagccugugcccggugcgggggugggccaucuacuccaaggacaacagcauccgcaucggcuccaagggggacgucuucgugauccgggagcccuucaucagcugcucccaccucgagugccgcacguucuuccugacccagggcgcccugcucaacgacaagcacagcaacgggaccgugaaggaccggucccccuaccgcgcccugaugagcugccccaucggcgaggccccgucccccuacaacagccgguucgaguccgucgcguggagcgccagcgccugccacgacggcaugggguggcugaccaucggcaucuccgggcccgacgacggcgccguggcggugcucaaguacaacggcaucaucacggagaccaucaagagcuggcgcaagcggauccugcgcacccaggaguccgagugcgucugcgugaacgggagcugcuucaccaucaugacggacggccccuccaacgggccggccagcuacaagaucuucaagaucgagaagggcaagaucaccaaguccaucgagcuggacgcccccaacagccacuacgaggagugcuccugcuaccccgacaccgggaccgugaugugcgucugccgggacaacuggcacggcagcaaccgccccuggguguccuucaaccagaaccucgacuaccagcugggcuacaucugcagcgggaucuucggcgacaacccgcggcccaaggacgggaagggcuccugcgggcccgugacggucgacggcgccgacggcgugaagggguucagcuaccgcuacggcaacgggguguggaucggccggaccaaguccaacagcucccgcaagggguucgagaugaucugggaccccaacggcuggaccgacaccgacagcaacuuccuggucaagcaggacgugguggccaugacggacugguccggcuacagcgggagcuucguccagcacccggagcucaccggccuggacugcaugcggcccugcuucuggguggagcugauccgcgggcggccccgcgagaccaccacgaucuggaccuccggcagcuccaucagcuucugcggcgucaacuccgacaccgugaacuggagcuggcccgacggggcggagcucccguucaccaucgacaaguga

SEQ ID NO: 76272 - RNA, 1410 nt, Artificial Sequence
  derived and/or modified sequence opt1 from neuraminidase__InfluenzaA__ABG88358
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacaagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgaccgggcggacaccaagauccuguucaucgaggaggggaagaucguccacauccgcccccugagcggcagcgcccagcacguggaggagugcuccugcuacccccgguacccgggggugcgcugcgucugccgggacaacuggaagggcagcaaccgccccaucguggacaucaacgugaaggacuacuccaucgucagcuccuacgugugcagcggccucgugggggacacgccccggaagaacgacuccagcuccagcuccuacugcuggaaccccaacaacgagaagggcgggcacggcgucaaggggugggccuucgacgacggcaacgacguguggaugggccgcaccaucagcgaggagucccggagcggguacgagaccuucaaggucaucggcgggugguccaagccgaacagcaagcugcagaucaaccgccaggugaucguggaccggggcaaccgcuccggguacagcggcaucuucuccgucgagggcaagagcugcaucaaccggugcuucuacguggagcugauccgcgggcgcaagcaggagaccgaggugugguggacgagcaacuccaucgucguguucugcggcaccagcgggaccuacggcaccggguccuggcccgacggcgccgacaucaaccucaugcccaucuga

SEQ ID NO: 76273 - RNA, 1410 nt, Artificial Sequence; identical to SEQ ID NO: 76121
  derived and/or modified sequence opt1 from neuraminidase__InfluenzaA__ABG88369

SEQ ID NO: 76274 - RNA, 1410 nt, Artificial Sequence; identical to SEQ ID NO: 76121
  derived and/or modified sequence opt1 from neuraminidase__InfluenzaA__ABG88380

SEQ ID NO: 76275 - RNA, 1410 nt, Artificial Sequence; identical to SEQ ID NO: 76121
  derived and/or modified sequence opt1 from neuraminidase__InfluenzaA__ABG88391

SEQ ID NO: 76276 - RNA, 1410 nt, Artificial Sequence; identical to SEQ ID NO: 76108
  derived and/or modified sequence opt1 from neuraminidase__InfluenzaA__ABG88402

SEQ ID NO: 76277 - RNA, 1410 nt, Artificial Sequence; identical to SEQ ID NO: 76165
  derived and/or modified sequence opt1 from neuraminidase__InfluenzaA__ABG88413

SEQ ID NO: 76278 - RNA, 1410 nt, Artificial Sequence; identical to SEQ ID NO: 76109
  derived and/or modified sequence opt1 from neuraminidase__InfluenzaA__ABG88424

SEQ ID NO: 76279 - RNA, 1410 nt, Artificial Sequence; identical to SEQ ID NO: 76109
  derived and/or modified sequence opt1 from neuraminidase__InfluenzaA__ABG88435

SEQ ID NO: 76280 - RNA, 1410 nt, Artificial Sequence; identical to SEQ ID NO: 76109
  derived and/or modified sequence opt1 from neuraminidase__InfluenzaA__ABG88446

SEQ ID NO: 76281 - RNA, 1410 nt, Artificial Sequence
  derived and/or modified sequence opt1 from neuraminidase__InfluenzaA__ABG88457
augaaccccaaccagaagaucaucaccaucggcagcgugucccugaccacggccaccaucugcuuccucaugcagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcacgacccugaacaaccgccacagcaacgacaccguccacgaccggaccccguaccgcacgcuccugaugaacgagcugggcgugcccuuccaccucgggaccaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacgcaggaguccgagugcgucugcaucaacgggaccugcaccguggugaugaccgacggcagcgccuccgagcgggcggacacgaagauccuguucaucaaggagggcaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccagaaccccaacaacgagaagggcucccacggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggaccuccaacagcaucgucguguucugcgggaccuccggcaccuacgggacgggcagcuggcccgacggggccgacaucaaccugaugcccaucuga

SEQ ID NO: 76282 - RNA, 1410 nt, Artificial Sequence; identical to SEQ ID NO: 76109
  derived and/or modified sequence opt1 from neuraminidase__InfluenzaA__ABG88468

SEQ ID NO: 76283 - RNA, 1410 nt, Artificial Sequence; identical to SEQ ID NO: 76109
  derived and/or modified sequence opt1 from neuraminidase__InfluenzaA__ABG88479

SEQ ID NO: 76284 - RNA, 1410 nt, Artificial Sequence; identical to SEQ ID NO: 76109
  derived and/or modified sequence opt1 from neuraminidase__InfluenzaA__ABG88490

SEQ ID NO: 76285 - RNA, 1410 nt, Artificial Sequence; identical to SEQ ID NO: 76109
  derived and/or modified sequence opt1 from neuraminidase__InfluenzaA__ABG88501

SEQ ID NO: 76286 - RNA, 1410 nt, Artificial Sequence; identical to SEQ ID NO: 76109
  derived and/or modified sequence opt1 from neuraminidase__InfluenzaA__ABG88512

SEQ ID NO: 76287 - RNA, 1410 nt, Artificial Sequence; identical to SEQ ID NO: 76109
  derived and/or modified sequence opt1 from neuraminidase__InfluenzaA__ABG88523

SEQ ID NO: 76288 - RNA, 1410 nt, Artificial Sequence
  derived and/or modified sequence opt1 from neuraminidase__InfluenzaA__ABG88534
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaaccccaacaacgagaagggcagccacggggucaagggcugggccuucgacgacgggaacgacguguggaugggccgcaccaucuccgaggagcugcggagcggcuacgagaccuucaaggucaucgggggcugguccaagccgaacagcaagcugcagaucaaccgccaggugaucguggaccgggggaaccgcuccggcuacagcgggaucuucagcgucgagaacaaguccugcaucaaccggugcuucuacguggagcucauccgcggccgcaagcaggagaccgaggugugguggacgagcaacuccaucgucguguucugcggcaccagcgggaccuacggcaccggguccuggcccgacggcgccgacaucaaccugaugcccaucuga

SEQ ID NO: 76289 - RNA, 1410 nt, Artificial Sequence; identical to SEQ ID NO: 75801
  derived and/or modified sequence opt1 from neuraminidase__InfluenzaA__ABG88567

SEQ ID NO: 76290 - RNA, 1410 nt, Artificial Sequence
  derived and/or modified sequence opt1 from neuraminidase__InfluenzaA__ABG88600
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagccggcggaguaccggaacugguccaagccccagugcaacaucaccggguucgcccccuucagcaaggacaacuccauccgccugagcgccggcggggacaucugggugacccgggagcccuacguguccugcgacccggacaagugcuaccaguucgcccucggccaggggaccacgcugaacaacggccacagcaacgacaccguccacgaccgcacccccuaccggacccugcucaugaacgagcugggcgugcccuuccaccuggggacgaagcaggucugcaucgccugguccagcuccagcugccacgacggcaaggcguggcuccacgugugcgugaccggggacgacgagaacgccaccgccuccuucaucuacaacggccgccugguggacagcaucggguccuggagcaagaagauccugcggacccaggaguccgagugcgucugcaucaacggcacgugcaccguggugaugaccgacggcagcgccuccgggaaggcggacaccaagauccucuucaucgaggagggcaagaucguccacacgagccugcugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacagcaagcuccagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcuguggaccagcaacuccaucgucguguucugcggcaccagcgggaccuacggcacgggguccuggcccgacggcgccgacaucaaccucaugcccaucuga

SEQ ID NO: 76291 - RNA, 1410 nt, Artificial Sequence; identical to SEQ ID NO: 75162
  derived and/or modified sequence opt1 from neuraminidase__InfluenzaA__ABG88611

SEQ ID NO: 76292 - RNA, 1410 nt, Artificial Sequence; identical to SEQ ID NO: 75174
  derived and/or modified sequence opt1 from neuraminidase__InfluenzaA__ABG88622

SEQ ID NO: 76293 - RNA, 1410 nt, Artificial Sequence; identical to SEQ ID NO: 75162
  derived and/or modified sequence opt1 from neuraminidase__InfluenzaA__ABG88633

SEQ ID NO: 76294 - RNA, 1410 nt, Artificial Sequence; identical to SEQ ID NO: 76213
  derived and/or modified sequence opt1 from neuraminidase__InfluenzaA__ABG88655

SEQ ID NO: 76295 - RNA, 1410 nt, Artificial Sequence; identical to SEQ ID NO: 76213
  derived and/or modified sequence opt1 from neuraminidase__InfluenzaA__ABG88666

SEQ ID NO: 76296 - RNA, 1410 nt, Artificial Sequence; identical to SEQ ID NO: 75599
  derived and/or modified sequence opt1 from neuraminidase__InfluenzaA__ABG88677

SEQ ID NO: 76297 - RNA, 1410 nt, Artificial Sequence; identical to SEQ ID NO: 76213
  derived and/or modified sequence opt1 from neuraminidase__InfluenzaA__ABG88688

SEQ ID NO: 76298 - RNA, 1410 nt, Artificial Sequence; identical to SEQ ID NO: 75599
  derived and/or modified sequence opt1 from neuraminidase__InfluenzaA__ABG88699

SEQ ID NO: 76299 - RNA, 1410 nt, Artificial Sequence; identical to SEQ ID NO: 75335
  derived and/or modified sequence opt1 from neuraminidase__InfluenzaA__ABG88710

SEQ ID NO: 76300 - RNA, 1410 nt, Artificial Sequence; identical to SEQ ID NO: 75335
  derived and/or modified sequence opt1 from neuraminidase__InfluenzaA__ABG88721

SEQ ID NO: 76301 - RNA, 1410 nt, Artificial Sequence
  derived and/or modified sequence opt1 from neuraminidase__InfluenzaA__ABG88732
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggagcgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 76302 - RNA, 1410 nt, Artificial Sequence; identical to SEQ ID NO: 76261
  derived and/or modified sequence opt1 from neuraminidase__InfluenzaA__ABG88743

SEQ ID NO: 76303 - RNA, 1410 nt, Artificial Sequence; identical to SEQ ID NO: 76261
  derived and/or modified sequence opt1 from neuraminidase__InfluenzaA__ABG88754

SEQ ID NO: 76304 - RNA, 1410 nt, Artificial Sequence; identical to SEQ ID NO: 75527
  derived and/or modified sequence opt1 from neuraminidase__InfluenzaA__ABG88765

SEQ ID NO: 76305 - RNA, 1410 nt, Artificial Sequence; identical to SEQ ID NO: 76193
  derived and/or modified sequence opt1 from neuraminidase__InfluenzaA__ABG88776

SEQ ID NO: 76306 - RNA, 1410 nt, Artificial Sequence; identical to SEQ ID NO: 76193
  derived and/or modified sequence opt1 from neuraminidase__InfluenzaA__ABG88787

SEQ ID NO: 76307 - RNA, 1410 nt, Artificial Sequence
  derived and/or modified sequence opt1 from neuraminidase__InfluenzaA__ABG88820
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcggcugggcuacgagaccuucaaggucaucgaggggugguccaaccccaacagcaagcuccagaccaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcacgagcgggaccuacggcaccggguccuggccggacggcgccgacaucaaccucaugcccaucuga

SEQ ID NO: 76308 - RNA, 1350 nt, Artificial Sequence
  derived and/or modified sequence opt1 from neuraminidase__InfluenzaA__ABI16506
augaaccccaaccagaagaucaucaccaucggcagcaucugcauggugaucgggaucgucucccugaugcuccagaucggcaacauggugagccugugggugucccacagcauccagaccgggaaccagcaccaggucgagccgaucuccaacacgaacuuccugaccgagaaggccguggccagcgugacccucgcgggcaacuccagccugugccccauccgcgggugggccguccacuccaaggacaacagcauccggaucggcuccaagggcgacguguucgugauccgcgagcccuucaucagcugcucccaccuggagugccggaccuucuuccucacgcagggggcccugcugaacgacaagcacagcaacggcaccgucaaggaccgcagcccccaccggacccucauguccugcccggugggggaggcccccucccccuacaacagccgcuucgaguccguggccuggagcgcgagcgccugccacgacggcaccuccuggcugacgaucgggaucagcggccccgacaacggcgccgucgccgugcugaaguacaacgggaugaucaccgacaccaucaaguccuggcggaacaacauccuccgcacccaggagagcgagugcgugugcgucaacggcuccugcuucacggugaugaccgacgggccgagcaacggccaggcguccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgccuacggggucaagggcuucuccuucaaguacgggaacggcguguggaucggccgcaccaagagcccguccagccgguccggguucgagaugaucugggaccccaacggcuggaccgagaccgacagcagcuucuccgucaagcaggacaucguggccaucaccgacuggagcggguacuccggcagcuucgugcagcaccccgagcucacggggcuggacugcauccgccccugcuucugggucgagcugauccggggccgcccgaaggaguccaccaucuggaccagcggcuccagcaucuccuucugcggggugaacagcgacaccguguccuggagcuggcccgacggcgcggagcuccccuucacgaucgacaaguga

SEQ ID NO: 76309 - RNA, 1413 nt, Artificial Sequence; identical to SEQ ID NO: 75973
  derived and/or modified sequence opt1 from neuraminidase__InfluenzaA__ABI20840

SEQ ID NO: 76310 - RNA, 1413 nt, Artificial Sequence
  derived and/or modified sequence opt1 from neuraminidase__InfluenzaA__ABI20862
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccagcaacggcccggcguccuaccggaucuucaagaucgagaaggggaagaucaccaagagcaucgagcuggacgcccccaacucccacuacgaggagugcagcugcuaccccgacaccggcacggugaugugcgugugccgcgacaacuggcacggguccaaccggcccugggucagcuucaaccagaaccucgacuaccagaccggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggacggacaccgacuccaacuuccuggucaagcaggacgugguggccaugaccgacuggagcggguacagcggcuccuucguccagcacccggagcugaccggccucgacugcaugcgccccugcuucuggguggagcugauccgggggcgcccccgggagaagacgaccaucuggaccagcggcuccagcaucuccuucugcggggucaacagcgacaccgccaacugguccuggcccgacggcgcggagcugccguucacgaucgacaaguga

SEQ ID NO: 76311 - RNA, 1413 nt, Artificial Sequence
  derived and/or modified sequence opt1 from neuraminidase__InfluenzaA__ABI20873
augaaccccaaccagaagaucaucaccaucggcagcaucuccauggccaucgggaucaucagccugacccuccagaucggcaacaucaucuccaucugggccagccacuccauccagacggggagccagaaccacaccggcaucugcaaccagcgcaucaucaccuacgagaacuccaccugggugaaccagacguacgucaacaucaacaacaccaacgugguggcggagaaggacaagaccagcgucacccuggccgggaacuccagccugugcccgauccggggcugggccaucuacacgaaggacaacuccauccgcaucggcagcaagggggacguguucgugauccgggagcccuucaucuccugcagccaccucgagugccgcaccuucuuccugacccagggcgcccugcucaacgacaagcacuccaacgggaccgucaaggaccggagccccuaccgcgcccugauguccugcccccugggcgaggcgccgagccccuacaacucccgguucgagagcguggccuggagcgccacggccugccacgacgggaucggcuggcucaccaucggcaucuccgggcccgacaacggcgcgguggccguccugaaguacaacggggugaucaccgagaccaucaagagcuggaagaagcagauccugcgcacgcaggaguccgagugcgugugcgucaacggcagcugcuucaccaucaugaccgacggccccuccaacggggccgccagcuaccggaucuucaagaucgagaagggcaagaucaccaaguccaucgagcucgacgccccgaacuuccacuacgaggagugcagcugcuaccccgacacggggaccgugaugugcgugugccgcgacaacuggcacggcuccaaccggcccugggucagcuucaaccagaaccuggacuaccagaucggguacaucugcuccggcguguucggcgacaacccccgcccgaaggacggggagggcagcugcaaccccgugaccgucgacggggcggacggcgugaagggguucuccuaccgguacggcaacggcguguggaucgggcgcaccaagagcaaccggcugcgcaagggcuucgagaucaucugggaccccaacggguggacggacaccgacuccgacuucagcgucaagcaggacgugguggccaugaccgacugguccggcuacagcggguccuucguccagcaccccgagcucaccggccuggacugcaugcggccgugcuucuggguggagcugguccgcggccucccccgggagaacgccacgaucuggaccagcgggagcuccaucagcuucugcggcgugaacuccgacaccgccaacuggagcuggcccgacggggccgagcugcccuucaccaucgacaaguga

SEQ ID NO: 76312 - RNA, 1410 nt, Artificial Sequence; identical to SEQ ID NO: 76108
  derived and/or modified sequence opt1 from neuraminidase__InfluenzaA__ABI20895

SEQ ID NO: 76313 - RNA, 1410 nt, Artificial Sequence; identical to SEQ ID NO: 76121
  derived and/or modified sequence opt1 from neuraminidase__InfluenzaA__ABI20906

SEQ ID NO: 76314 - RNA, 1410 nt, Artificial Sequence; identical to SEQ ID NO: 76109
  derived and/or modified sequence opt1 from neuraminidase__InfluenzaA__ABI20928

SEQ ID NO: 76315 - RNA, 1410 nt, Artificial Sequence; identical to SEQ ID NO: 76109
  derived and/or modified sequence opt1 from neuraminidase__InfluenzaA__ABI20939

SEQ ID NO: 76316 - RNA, 1410 nt, Artificial Sequence; identical to SEQ ID NO: 76109
  derived and/or modified sequence opt1 from neuraminidase__InfluenzaA__ABI20950

SEQ ID NO: 76317 - RNA, 1410 nt, Artificial Sequence; identical to SEQ ID NO: 76109
  derived and/or modified sequence opt1 from neuraminidase__InfluenzaA__ABI20961

SEQ ID NO: 76318 - RNA, 1410 nt, Artificial Sequence; identical to SEQ ID NO: 75835
  derived and/or modified sequence opt1 from neuraminidase__InfluenzaA__ABI20983

SEQ ID NO: 76319 - RNA, 1410 nt, Artificial Sequence
  derived and/or modified sequence opt1 from neuraminidase__InfluenzaA__ABI20994
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacaaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 76320 - RNA, 1410 nt, Artificial Sequence
  derived and/or modified sequence opt1 from neuraminidase__InfluenzaA__ABI21005
augaaccccaaccagaagaucaucaccaucggcagcgugucccugaccaucgccacgaucugcuuccucaugcagaucgccguccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccuggccgacagcaucggguccuggagcaagaagauccuccggacccaggaguccgagugcgucugcaucaacggcacgugcaccguggugaugaccgacggcagcgcguccgggaaggccgacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 76321 - RNA, 1410 nt, Artificial Sequence; identical to SEQ ID NO: 75162
  derived and/or modified sequence opt1 from neuraminidase__InfluenzaA__ABI21016

SEQ ID NO: 76322 - RNA, 1410 nt, Artificial Sequence
  derived and/or modified sequence opt1 from neuraminidase__InfluenzaA__ABI21027
augaaccccaaccagcgcaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcggaacaucaccgagaucgucuaccugaccaacaccacgaucgagaaggagaucugccccaagcuggcggaguaccgcaacugguccaagccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccccggggacguacggcaccggguccuggcccgacggcgccgacaucaaccugaugcccaucuga

SEQ ID NO: 76323 - RNA, 1410 nt, Artificial Sequence; identical to SEQ ID NO: 75599
  derived and/or modified sequence opt1 from neuraminidase__InfluenzaA__ABI21038

SEQ ID NO: 76324 - RNA, 1410 nt, Artificial Sequence
  derived and/or modified sequence opt1 from neuraminidase__InfluenzaA__ABI21049
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccggguacgugugcagcggccucgucggggacacgccccggaagaacgacuccuucagcuccagccacugccuggaccccaacaacgaggagggcgggcacggcgugaagggcugggccuucgacgacgggaacgacgucuggaugggccgcaccaucuccgagaagcugcggagcggguacgagaccuucaaggugaucgagggcugguccaagcccaacagcaagcuccagaucaaccgccaggugaucgucgagcgggggaaccgcuccggcuacagcggcaucuucuccguggagggcaagagcugcaucaaccggugcuucuacguggagcugauccgcgggcggaaggaggagaccgaggucugguggaccuccaacagcaucgugguguucugcgggaccagcggcaccuacgggacgggcuccuggccggacggcgccgacaucaaccugaugcccaucuga

SEQ ID NO: 76325 - RNA, 1410 nt, Artificial Sequence
  derived and/or modified sequence opt1 from neuraminidase__InfluenzaA__ABI21060
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagccgguggaguaccggaacugguccaagccccagugcaacaucaccggguucgcgcccuucagcaaggacaacuccauccgccugagcgccggcggggacaucugggugacccgggagcccuacgucuccugcgacccggacaagugcuaccaguucgcccucggccaggggaccacgcugaacaacggccacagcaacgacaccgugcacgaccgcacccccuaccggacccugcucaugaacgagcugggcgugcccuuccaccuggggacgcgccaggucugcaucgccugguccagcuccagcugccacgacggcaaggccuggcuccacgugugcgugaccggggacgacaagaacgcgaccgccuccuucaucuacaacggccggcuggucgacagcaucggguccuggagcaagaagauccugcgcacccaggaguccgagugcgugugcaucaacggcacgugcaccguggucaugaccgacggcagcgccuccgggaaggccgacaccaagauccucuucaucgaggagggcaagaucgugcacaucagcacgcugagcggguccgcgcagcacguggaggagugcagcugcuacccccgguacccgggcguccgcugcgugugccgggacaacuggaagggcuccaaccgccccaucguggacaucaacgucaaggacuacagcaucguguccagcuacgugugcuccgggcuggucggcgacacgccccggaagaacgacagcuucuccagcucccacugccucgaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagccgaacuccaagcugcagaucaaccgccaggugaucgucgagcggggcaaccgcagcggguacuccggcaucuucagcguggagggcaaguccugcaucaaccggugcuucuacguggagcucauccgcgggcggaaggaggagaccgaggucugguggaccagcaacagcaucgugguguucugcggcaccuccgggaccuacggcacggggagcuggcccgacggcgccgacaucaaccugaugcccaucuga

SEQ ID NO: 76326 - RNA, 1410 nt, Artificial Sequence
  derived and/or modified sequence opt1 from neuraminidase__InfluenzaA__ABI21071
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugagcgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 76327 - RNA, 1410 nt, Artificial Sequence
  derived and/or modified sequence opt1 from neuraminidase__InfluenzaA__ABI21082
augaaccccaaccagaagaucaucaccaucggcagcgugucccugaccaucagcacgaucugcuucuucaugcagaucgccacccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 76328 - RNA, 1410 nt, Artificial Sequence; identical to SEQ ID NO: 75744
  derived and/or modified sequence opt1 from neuraminidase__InfluenzaA__ABI21093

SEQ ID NO: 76329 - RNA, 1410 nt, Artificial Sequence
  derived and/or modified sequence opt1 from neuraminidase__InfluenzaA__ABI21104
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucgccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggcguggcuccacgugugcgugacgggcgacgacaagaacgccaccgccagcuucaucuacaacgggcgccugguggacuccaucgucagcugguccaaggagauccugcggacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgaggggaagaacugcaucaaccgcugcuucuacguggagcucauccggggccgcaaggaggagaccgaggugcuguggaccagcaacuccaucgucguguucugcggcaccagcgggaccuacggcacgggguccuggccggacggcgccgacaucaaccugaugcccaucuga

SEQ ID NO: 76330 - RNA, 1410 nt, Artificial Sequence; identical to SEQ ID NO: 75335
  derived and/or modified sequence opt1 from neuraminidase__InfluenzaA__ABI21115

SEQ ID NO: 76331 - RNA, 1410 nt, Artificial Sequence; identical to SEQ ID NO: 75335
  derived and/or modified sequence opt1 from neuraminidase__InfluenzaA__ABI21126

SEQ ID NO: 76332 - RNA, 1410 nt, Artificial Sequence; identical to SEQ ID NO: 75744
  derived and/or modified sequence opt1 from neuraminidase__InfluenzaA__ABI21137

SEQ ID NO: 76333 - RNA, 1410 nt, Artificial Sequence; identical to SEQ ID NO: 75335
  derived and/or modified sequence opt1 from neuraminidase__InfluenzaA__ABI21148

SEQ ID NO: 76334 - RNA, 1410 nt, Artificial Sequence
  derived and/or modified sequence opt1 from neuraminidase__InfluenzaA__ABI21159
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcggcuacgugugcuccggccuggugggggacacgccccgcaagaacgacagcuccagcuccagccacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 76335 - RNA, 1410 nt, Artificial Sequence; identical to SEQ ID NO: 75335
  derived and/or modified sequence opt1 from neuraminidase__InfluenzaA__ABI21170

SEQ ID NO: 76336 - RNA, 1410 nt, Artificial Sequence; identical to SEQ ID NO: 75335
  derived and/or modified sequence opt1 from neuraminidase__InfluenzaA__ABI21181

SEQ ID NO: 76337 - RNA, 1413 nt, Artificial Sequence
  derived and/or modified sequence opt1 from neuraminidase__InfluenzaA__ABI21192
augaaccccaaccagaagaucaucaccaucggcagcaucuccaucgccaucgggaucaucagccugaugcuccagaucggcaacaucaucuccaucugggccagccacuccauccagaccgggagccagaaccacacggggaccugcaaccagcgcaucaucaccuacgagaacuccaccugggugaaccacacguacgucaacaucaacaacaccaacgugguggcgggcaaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccgagaccaucaaguccuggcgcaagcggauccugcgcacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgggacaacuggcacgggagcaaccgccccugggucuccuucaaccagaaccuggacuaccagaucggcuacaucugcagcggcguguucggggacaacccccggcccaaggacggcaagggguccugcaacccggugaccgucgacggcgcggacggggugaagggcuucagcuacaaguacggcaacgggguguggaucggccgcaccaaguccaaccggcugcgcaagggguucgagaugaucugggaccccaacggcuggaccgacacggacagcgacuucuccgucaagcaggacgugguggccaucaccgacuggagcggguacagcggcuccuucguccagcaccccgagcucaccggccuggacugcauccggcccugcuucuggguggagcugguccgcgggcucccgcgggagaacaccacgaucuggaccagcggcuccagcaucuccuucugcgggguggacagcgacaccgccaacugguccuggcccgacggcgccgagcugcccuucaucaucgacaaguga

SEQ ID NO: 76338 - RNA, 1413 nt, Artificial Sequence; identical to SEQ ID NO: 75394
  derived and/or modified sequence opt1 from neuraminidase__InfluenzaA__ABI21203

SEQ ID NO: 76339 - RNA, 1413 nt, Artificial Sequence
  derived and/or modified sequence opt1 from neuraminidase__InfluenzaA__ABI21214
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaucaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 76340 - RNA, 1410 nt, Artificial Sequence
  derived and/or modified sequence opt1 from neuraminidase__InfluenzaA__ABI21247
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggaccacagcaucgucuccagcuacgugugcuccggccucgugggggacacgccccgcaagaacgacagcuccagcuccagcuacugccggaaccccaacaacgagaagggcucccacgggaugaagggcugggccuucgacgacgggaacgacgucuggaugggccgcaccaucagcgaggagcugcgguccggcuacgagaccuucaaggugaucgggggcuggagcaagccgaacuccaagcugcagaucaaccgccaggucaucguggaccgggggaaccgcagcggcuacuccgggaucuucagcguggagggcaagagcugcaucaaccggugcuucuacgucgagcucauccgcggccgcaagcaggagaccgaggugugguggacguccaacagcaucguggucuucugcgggaccuccggcaccuacgggaccggcagcuggcccgacggggccgacaucaaccugaugcccaucuga

SEQ ID NO: 76341 - RNA, 1410 nt, Artificial Sequence; identical to SEQ ID NO: 76261
  derived and/or modified sequence opt1 from neuraminidase__InfluenzaA__ABI21258

SEQ ID NO: 76342 - RNA, 1410 nt, Artificial Sequence; identical to SEQ ID NO: 76261
  derived and/or modified sequence opt1 from neuraminidase__InfluenzaA__ABI21269

SEQ ID NO: 76343 - RNA, 1410 nt, Artificial Sequence; identical to SEQ ID NO: 76261
  derived and/or modified sequence opt1 from neuraminidase__InfluenzaA__ABI21280

SEQ ID NO: 76344 - RNA, 1410 nt, Artificial Sequence; identical to SEQ ID NO: 76193
  derived and/or modified sequence opt1 from neuraminidase__InfluenzaA__ABI21302

SEQ ID NO: 76345 - RNA, 1410 nt, Artificial Sequence; identical to SEQ ID NO: 76193
  derived and/or modified sequence opt1 from neuraminidase__InfluenzaA__ABI21313

SEQ ID NO: 76346 - RNA, 1410 nt, Artificial Sequence; identical to SEQ ID NO: 76193
  derived and/or modified sequence opt1 from neuraminidase__InfluenzaA__ABI21324

SEQ ID NO: 76347 - RNA, 1410 nt, Artificial Sequence; identical to SEQ ID NO: 76193
  derived and/or modified sequence opt1 from neuraminidase__InfluenzaA__ABI21335

SEQ ID NO: 76348 - RNA, 1410 nt, Artificial Sequence; identical to SEQ ID NO: 76261
  derived and/or modified sequence opt1 from neuraminidase__InfluenzaA__ABI21346

SEQ ID NO: 76349 - RNA, 1410 nt, Artificial Sequence
  derived and/or modified sequence opt1 from neuraminidase__InfluenzaA__ABI21357
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaagaacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggaggccgaggugugguggaccuccaacagcaucgucguguucugcgggacguccggcaccuacgggaccggcagcuggcccgacggggccgacaucaaccugaugcccaucuga

SEQ ID NO: 76350 - RNA, 1410 nt, Artificial Sequence; identical to SEQ ID NO: 76193
  derived and/or modified sequence opt1 from neuraminidase__InfluenzaA__ABI21368

SEQ ID NO: 76351 - RNA, 1410 nt, Artificial Sequence; identical to SEQ ID NO: 76193
  derived and/or modified sequence opt1 from neuraminidase__InfluenzaA__ABI21379

SEQ ID NO: 76352 - RNA, 1410 nt, Artificial Sequence; identical to SEQ ID NO: 76193
  derived and/or modified sequence opt1 from neuraminidase__InfluenzaA__ABI21390

SEQ ID NO: 76353 - RNA, 1410 nt, Artificial Sequence; identical to SEQ ID NO: 76261
  derived and/or modified sequence opt1 from neuraminidase__InfluenzaA__ABI21401

SEQ ID NO: 76354 - RNA, 1410 nt, Artificial Sequence
  derived and/or modified sequence opt1 from neuraminidase__InfluenzaA__ABI21412
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgcccccuucuccaaggacaacagcauccgccucuccgccggcggggacaucugggugacccgggagcccuacgugagcugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaacccgaacaacgagaagggcagccacggggucaagggcugggccuucgacgacgggaacgacguguggaugggccgcaccaucuccgaggagcugcggagcggcuacgagaccuucaaggucaucgggggcugguccaagcccaacagcaagcugcagaucaaccgccaggugaucguggaccgggggaaccgcuccggcuacagcgggaucuucuccgucgagggcaagagcugcaucaaccggugcuucuacguggagcucauccgcggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 76355 - RNA, 1410 nt, Artificial Sequence; identical to SEQ ID NO: 75527
  derived and/or modified sequence opt1 from neuraminidase__InfluenzaA__ABI21423

SEQ ID NO: 76356 - RNA, 1410 nt, Artificial Sequence; identical to SEQ ID NO: 76193
  derived and/or modified sequence opt1 from neuraminidase__InfluenzaA__ABI21434

SEQ ID NO: 76357 - RNA, 1410 nt, Artificial Sequence; identical to SEQ ID NO: 76261
  derived and/or modified sequence opt1 from neuraminidase__InfluenzaA__ABI21445

SEQ ID NO: 76358 - RNA, 1410 nt, Artificial Sequence; identical to SEQ ID NO: 76261
  derived and/or modified sequence opt1 from neuraminidase__InfluenzaA__ABI21456

SEQ ID NO: 76359 - RNA, 1410 nt, Artificial Sequence; identical to SEQ ID NO: 76354
  derived and/or modified sequence opt1 from neuraminidase__InfluenzaA__ABI21467

SEQ ID NO: 76360 - RNA, 1410 nt, Artificial Sequence; identical to SEQ ID NO: 76261
  derived and/or modified sequence opt1 from neuraminidase__InfluenzaA__ABI21478

SEQ ID NO: 76361 - RNA, 1410 nt, Artificial Sequence; identical to SEQ ID NO: 76261
  derived and/or modified sequence opt1 from neuraminidase__InfluenzaA__ABI21489

SEQ ID NO: 76362 - RNA, 1410 nt, Artificial Sequence; identical to SEQ ID NO: 76261
  derived and/or modified sequence opt1 from neuraminidase__InfluenzaA__ABI21500

SEQ ID NO: 76363 - RNA, 1410 nt, Artificial Sequence
  derived and/or modified sequence opt1 from neuraminidase__InfluenzaA__ABI21511
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaugugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacgacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 76364 - RNA, 1413 nt, Artificial Sequence
  derived and/or modified sequence opt1 from neuraminidase__InfluenzaA__ABI21533
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugaugcgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaucaagagcaucgagcucaacgcccccaacucccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucagcgucaagcaggacgugguggccaucaccgacuggagcggguacuccggcagcuucguccagcaccccgagcucacgggccuggacugcauccgccccugcuucuggguggagcugguccgggggcgcccgcgggagaacaccaccaucuggaccuccggcagcuccaucagcuucugcggggugaacuccgacacggccaacuggagcuggcccgacggcgccgagcuccccuucaccaucgacaaguga

SEQ ID NO: 76365 - RNA, 1413 nt, Artificial Sequence; identical to SEQ ID NO: 76364
  derived and/or modified sequence opt1 from neuraminidase__InfluenzaA__ABI21544

SEQ ID NO: 76366 - RNA, 1413 nt, Artificial Sequence; identical to SEQ ID NO: 76364
  derived and/or modified sequence opt1 from neuraminidase__InfluenzaA__ABI21555

SEQ ID NO: 76367 - RNA, 1413 nt, Artificial Sequence; identical to SEQ ID NO: 76364
  derived and/or modified sequence opt1 from neuraminidase__InfluenzaA__ABI21566

SEQ ID NO: 76368 - RNA, 1413 nt, Artificial Sequence; identical to SEQ ID NO: 76364
  derived and/or modified sequence opt1 from neuraminidase__InfluenzaA__ABI21577

SEQ ID NO: 76369 - RNA, 1413 nt, Artificial Sequence
  derived and/or modified sequence opt1 from neuraminidase__InfluenzaA__ABI22112
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacgagaucaucacggagaccaucaaguccuggaagaagcgcauccugcggacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggguacaucugcagcggcguguucggcgacaacccccgccccaaggacgggaagggcuccugcaacccggugacggucgacggggcggacggcgugaagggguucagcuacaaguacggcaacggcguguggaucgggcggaccaaguccaaccgccugcggaagggcuucgagaugaucugggaccccaacggguggaccgacaccgacagcgacuucuccgucaagcaggacgugguggccaucacggacuggagcggcuacagcggguccuucguccagcaccccgagcucaccggccuggacugcauccgccccugcuucuggguggagcugguccggggccucccgcgcgagaacaccaccaucuggacgagcggguccagcaucuccuucugcggcguggacagcgacaccgccaacugguccuggcccgacggggccgagcugcccuucaccaucgacaaguga

SEQ ID NO: 76370 - RNA, 1410 nt, Artificial Sequence
  derived and/or modified sequence opt1 from neuraminidase__InfluenzaA__ABI22162
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucgaccugaugcccaucuga

SEQ ID NO: 76371 - RNA, 1350 nt, Artificial Sequence
  derived and/or modified sequence opt1 from neuraminidase__InfluenzaA__ABI23981
augaaccccaaccagaagaucaucaccaucggcagcaucugcauggugaucgggaucgucucccugaugcuccagaucggcaacaugaucagcaucugggugucccacagcauccagaccgggaaccagcgccaggccgaguccaucagcaacacgaaguuccugaccgagaaggccguggcguccgucacccuggccggcaacagcucccucugcccgaucagcgggugggccguguacuccaaggacaacagcauccggaucggcucccgcggcgacguguucgucauccgggagcccuucaucagcugcucccaccuggagugccgcaccuucuuccugacgcagggggcccuccugaacgacaagcacagcaacggcaccgugaaggaccggucccccuaccgcacccugaugagcucccccgugggggaggccccgagccccuacaacagccgguucgaguccgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggcccuccaacggccaggccagcuacaagaucuucaagauggagaagggcaagguggucaaguccguggagcucgacgccccgaacuaccacuacgaggagugcagcugcuaccccgacgccggggagaucacgugcgugugccgcgacaacuggcacggcuccaaccggcccugggucagcuucaaccagaaccuggaguaccagaucggguacaucugcuccggcguguucggggacaacccccgcccgaacgacggcaccggcagcugcgggcccgugucccugaacggcgcguacggggucaagggcuucagcuucaaguacgggaacggcguguggaucggccggaccaaguccaccaacagccgcagcggguucgagaugaucugggaccccaacggcuggaccgggaccgacuccagcuucuccgugaagcaggacaucgucgccaucacggacuggagcggcuacuccgggagcuucgugcagcaccccgagcucaccggccuggacugcauccggccgugcuucugggucgagcugauccgcggccggcccaaggaguccaccaucuggaccagcggguccagcaucuccuucugcggcgugaacagcgacacgguguccuggagcuggcccgacggggccgagcuccccuucaccaucgacaaguga

SEQ ID NO: 76372 - RNA, 1410 nt, Artificial Sequence; identical to SEQ ID NO: 75335
  derived and/or modified sequence opt1 from neuraminidase__InfluenzaA__ABI26649

SEQ ID NO: 76373 - RNA, 1413 nt, Artificial Sequence; identical to SEQ ID NO: 76058
  derived and/or modified sequence opt1 from neuraminidase__InfluenzaA__ABI30370

SEQ ID NO: 76374 - RNA, 1410 nt, Artificial Sequence; identical to SEQ ID NO: 76109
  derived and/or modified sequence opt1 from neuraminidase__InfluenzaA__ABI30392

SEQ ID NO: 76375 - RNA, 1410 nt, Artificial Sequence; identical to SEQ ID NO: 75738
  derived and/or modified sequence opt1 from neuraminidase__InfluenzaA__ABI30403

SEQ ID NO: 76376 - RNA, 1410 nt, Artificial Sequence; identical to SEQ ID NO: 75738
  derived and/or modified sequence opt1 from neuraminidase__InfluenzaA__ABI30414

SEQ ID NO: 76377 - RNA, 1410 nt, Artificial Sequence; identical to SEQ ID NO: 75335
  derived and/or modified sequence opt1 from neuraminidase__InfluenzaA__ABI30425

SEQ ID NO: 76378 - RNA, 1410 nt, Artificial Sequence; identical to SEQ ID NO: 75335
  derived and/or modified sequence opt1 from neuraminidase__InfluenzaA__ABI30436

SEQ ID NO: 76379 - RNA, 1410 nt, Artificial Sequence; identical to SEQ ID NO: 75335
  derived and/or modified sequence opt1 from neuraminidase__InfluenzaA__ABI30447

SEQ ID NO: 76380 - RNA, 1410 nt, Artificial Sequence; identical to SEQ ID NO: 75335
  derived and/or modified sequence opt1 from neuraminidase__InfluenzaA__ABI30458

SEQ ID NO: 76381 - RNA, 1410 nt, Artificial Sequence; identical to SEQ ID NO: 75335
  derived and/or modified sequence opt1 from neuraminidase__InfluenzaA__ABI30469

SEQ ID NO: 76382 - RNA, 1410 nt, Artificial Sequence; identical to SEQ ID NO: 75335
  derived and/or modified sequence opt1 from neuraminidase__InfluenzaA__ABI30480

SEQ ID NO: 76383 - RNA, 1410 nt, Artificial Sequence
  derived and/or modified sequence opt1 from neuraminidase__InfluenzaA__ABI30491
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccaagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76384 - RNA, 1410 nt, Artificial Sequence; identical to SEQ ID NO: 75335
  derived and/or modified sequence opt1 from neuraminidase__InfluenzaA__ABI30502

SEQ ID NO: 76385 - RNA, 1410 nt, Artificial Sequence
  derived and/or modified sequence opt1 from neuraminidase__InfluenzaA__ABI30513
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 76386 - RNA, 1410 nt, Artificial Sequence; identical to SEQ ID NO: 75335
  derived and/or modified sequence opt1 from neuraminidase__InfluenzaA__ABI30524

SEQ ID NO: 76387 - RNA, 1410 nt, Artificial Sequence; identical to SEQ ID NO: 75335
  derived and/or modified sequence opt1 from neuraminidase__InfluenzaA__ABI30535

SEQ ID NO: 76388 - RNA, 1410 nt, Artificial Sequence
  derived and/or modified sequence opt1 from neuraminidase__InfluenzaA__ABI30546
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaaccugcacuccaacgacaccgugcacgaccgcaccccguaccggacccuccugaugagcgagcugggcguccccuuccaccucggcacgaagcaggucugcaucgccugguccagcuccagcugccacgacgggaaggccuggaugcacgugugcgugaccggcgacgacaagaacgcgaccgccuccuucaucuacaacgggcgccugguggacagcaucguguccuggagcaaggagauccugcggacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgcuaccccggcgugcggugcgucugccgcgacaacuggaagggguccaaccggccgaucguggacaucaacaucaaggacuacagcaucguguccagcuacgucugcuccggccuggugggcgacacgccccgcaagaacgacagcuccagcuccagccacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacagcaagcugcagaucaaccggcaggucaucguggaccgcggcaaccgguccggguacagcggcaucuucagcguggaggggaagaacugcaucaaccgcugcuucuacgucgagcucauccggggccgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 76389 - RNA, 1410 nt, Artificial Sequence; identical to SEQ ID NO: 75335
  derived and/or modified sequence opt1 from neuraminidase__InfluenzaA__ABI30557

SEQ ID NO: 76390 - RNA, 1410 nt, Artificial Sequence; identical to SEQ ID NO: 75722
  derived and/or modified sequence opt1 from neuraminidase__InfluenzaA__ABI30579

SEQ ID NO: 76391 - RNA, 1410 nt, Artificial Sequence
  derived and/or modified sequence opt1 from neuraminidase__InfluenzaA__ABI30590
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgaggggaagggcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 76392 - RNA, 1410 nt, Artificial Sequence; identical to SEQ ID NO: 75815
  derived and/or modified sequence opt1 from neuraminidase__InfluenzaA__ABI30601

SEQ ID NO: 76393 - RNA, 1410 nt, Artificial Sequence
  derived and/or modified sequence opt1 from neuraminidase__InfluenzaA__ABI30612
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 76394 - RNA, 1410 nt, Artificial Sequence; identical to SEQ ID NO: 75815
  derived and/or modified sequence opt1 from neuraminidase__InfluenzaA__ABI30623

SEQ ID NO: 76395 - RNA, 1410 nt, Artificial Sequence
  derived and/or modified sequence opt1 from neuraminidase__InfluenzaA__ABI30736
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccgucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 76396 - RNA, 1410 nt, Artificial Sequence
  derived and/or modified sequence opt1 from neuraminidase__InfluenzaA__ABI30758
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcuguacgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76397 - RNA, 1410 nt, Artificial Sequence; identical to SEQ ID NO: 75722
  derived and/or modified sequence opt1 from neuraminidase__InfluenzaA__ABI30769

SEQ ID NO: 76398 - RNA, 1410 nt, Artificial Sequence; identical to SEQ ID NO: 75722
  derived and/or modified sequence opt1 from neuraminidase__InfluenzaA__ABI30780

SEQ ID NO: 76399 - RNA, 1410 nt, Artificial Sequence; identical to SEQ ID NO: 75722
  derived and/or modified sequence opt1 from neuraminidase__InfluenzaA__ABI30791

SEQ ID NO: 76400 - RNA, 1410 nt, Artificial Sequence; identical to SEQ ID NO: 75722
  derived and/or modified sequence opt1 from neuraminidase__InfluenzaA__ABI30802

SEQ ID NO: 76401 - RNA, 1410 nt, Artificial Sequence; identical to SEQ ID NO: 75722
  derived and/or modified sequence opt1 from neuraminidase__InfluenzaA__ABI30813

SEQ ID NO: 76402 - RNA, 1410 nt, Artificial Sequence; identical to SEQ ID NO: 75722
  derived and/or modified sequence opt1 from neuraminidase__InfluenzaA__ABI30824

SEQ ID NO: 76403 - RNA, 1410 nt, Artificial Sequence; identical to SEQ ID NO: 75722
  derived and/or modified sequence opt1 from neuraminidase__InfluenzaA__ABI30835

SEQ ID NO: 76404 - RNA, 1410 nt, Artificial Sequence; identical to SEQ ID NO: 75722
  derived and/or modified sequence opt1 from neuraminidase__InfluenzaA__ABI30846

SEQ ID NO: 76405 - RNA, 1410 nt, Artificial Sequence; identical to SEQ ID NO: 76193
  derived and/or modified sequence opt1 from neuraminidase__InfluenzaA__ABI30857

SEQ ID NO: 76406 - RNA, 1410 nt, Artificial Sequence; identical to SEQ ID NO: 76193
  derived and/or modified sequence opt1 from neuraminidase__InfluenzaA__ABI30868

SEQ ID NO: 76407 - RNA, 1350 nt, Artificial Sequence
  derived and/or modified sequence opt1 from neuraminidase__InfluenzaA__ABI36157
augaaccccaaccagaagaucaucaccaucggcagcaucugcauggccaucgggaccgugucccugaugcuccagaucggcaacaugaucagcaucugggucucccacagcauccagacggggaaccagcaccaggccgaguccaucagcaacaccaacccgcugaccgagaaggcgguggccuccgugacccuggccggcaacagcucccucugccccauccgcgggugggccguccacagcaaggacaacuccauccggaucggcagcaagggcgacguguucgugauccgcgagcccuucaucuccugcagccacuccgagugccggacguucuuccugacccagggggcccugcucaacgacaagcacagcaacgagaccgucaaggaccgcagcccccaccggacccugaugagcugcccggugggcgaggcgcccucccccuacaacagccgcuucgagagcguggccugguccgccagcgccugccacgacgggacguccuggcugaccaucggcaucagcgggcccgacaacggcgcggucgccgugcucaaguacaacggcaucaucaccgacaccaucaaguccuggcggaacaacauccugcgcacgcaggagagcgagugcgccugcgugaacggguccugcuucaccgucaugaccgacggcccgagcaacgggcaggccuccuacaagaucuucaagauggagaagggcaagguggugaaguccgucgagcuggacgcccccaacuaccacuacgaggagugcuccugcuaccccgacgcgggcgagaucacgugcgugugccgggacaacuggcacgggagcaaccgccccuggguguccuucaaccagaaccucgaguaccagaucggcuacaucugcagcggggucuucggcgacaacccgcggcccaacgacgggaccggcuccugcggccccaugagcuccaacggggccuacggcgugaagggguucagcuucaaguacggcaacgggguguggaucggccgcaccaaguccaccaacagccggagcggcuucgagaugaucugggaccccaacggguggaccggcacggacuccagcuucuccgucaagcaggacaucguggccaucaccgacuggagcggguacuccggcagcuucgugcagcacccggagcugaccgggcuggacugcauccgccccugcuucugggucgagcucauccggggccgccccaaggaguccaccaucuggacgagcggcuccagcaucuccuucugcggggugaacagcgacaccgucuccuggagcuggcccgacggcgccgagcugccguucaccaucgacaaguga

SEQ ID NO: 76408 - RNA, 1350 nt, Artificial Sequence; identical to SEQ ID NO: 76407
  derived and/or modified sequence opt1 from neuraminidase__InfluenzaA__ABI36168

SEQ ID NO: 76409 - RNA, 1350 nt, Artificial Sequence; identical to SEQ ID NO: 76407
  derived and/or modified sequence opt1 from neuraminidase__InfluenzaA__ABI36179

SEQ ID NO: 76410 - RNA, 1350 nt, Artificial Sequence; identical to SEQ ID NO: 76407
  derived and/or modified sequence opt1 from neuraminidase__InfluenzaA__ABI36189

SEQ ID NO: 76411 - RNA, 1350 nt, Artificial Sequence
  derived and/or modified sequence opt1 from neuraminidase__InfluenzaA__ABI36278
augaaccccaaccagaagaucaucaccaucggcagcaucugcauggugaucgggaucgucucccugaugcuccagaucggcaacaugaucagcaucugggugucccacagcauccagaaggggaaccagcaccaggccgaguccaucagcaacaccaacccgcugacggagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacccagggggcccuccugaacgacaagcacagcaacggcacggugaaggaccgcagcccccaccggacccugauguccugcccggugggggaggcccccucccccuacaacagccgcuucgaguccgucgcguggagcgccagcgccugccacgacggcaccuccuggcucaccaucgggaucagcggccccgacaacgaggccguggcggugcugaaguacaacggcaucaucacggacaccaucaaguccuggcggaacaacauccugcgcacccaggagagcgagugcgccugcgucaacggguccugcuucaccgugaugacggacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucaccgacugguccggguacagcggcuccuucguccagcaccccgagcugacggggcucgacugcauccgccccugcuucuggguggagcugauccggggccgccccaaggagagcaccaucuggaccuccggcagcuccaucagcuucugcggggucaacuccgacaccgugagcugguccuggccggacggcgccgagcugcccuucacgaucgacaaguga

SEQ ID NO: 76412 - RNA, 1350 nt, Artificial Sequence; identical to SEQ ID NO: 76411
  derived and/or modified sequence opt1 from neuraminidase__InfluenzaA__ABI36287

SEQ ID NO: 76413 - RNA, 1350 nt, Artificial Sequence; identical to SEQ ID NO: 76411
  derived and/or modified sequence opt1 from neuraminidase__InfluenzaA__ABI36298

SEQ ID NO: 76414 - RNA, 1350 nt, Artificial Sequence
  derived and/or modified sequence opt1 from neuraminidase__InfluenzaA__ABI36314
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaacuccuggcucaccaucgggaucagcggccccgacaacgaggccguggcggugcugaaguacaacggcaucaucacggacaccaucaaguccuggcggaacaacauccugcgcacccaggagagcgagugcgccugcgucaacggguccugcuucaccgugaugacggacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucaccgacugguccggguacagcggcuccuucguccagcaccccgagcugacggggcucgacugcauccgccccugcuucuggguggagcugauccggggccgccccaaggagagcaccaucuggaccuccggcagcuccaucagcuucugcggggucaacuccgacaccgugagcugguccuggccggacggcgccgagcugcccuucacgaucgacaaguga

SEQ ID NO: 76415 - RNA, 1350 nt, Artificial Sequence
  derived and/or modified sequence opt1 from neuraminidase__InfluenzaA__ABI36336
augaaccccaaccagaagaucaucaccaucggcagcaucugcauggugaucgggaucgucucccugaugcuccagaucggcaacaugaucagcaucugggugucccacagcgugcagaccgggaaccagcaccaggccgaguccaucagcaacacgaacccgcugaccgagaaggccgucgcguccgugacccuggccggcaacagcucccucugccccauccgcgggugggccgugcacagcaaggacaacaacauccggaucggcuccaagggcgacgucuucgugauccgcgagcccuucaucagcugcucccaccuggagugccggaccuucuuccugacgcagggggcccuccugaacgacaagcacagcaacggcaccgugaaggaccgcagcccccaccggacccugauguccugcccgcucggggaggcccccucccccuacaacagccgcuucgaguccgucagcuggagcgcguccgccugccacgacggcaccagcuggcugacgaucgggaucuccggccccgacaacgaggccguggccgugcugaaguacaacggcaucaucaccgacaccaucaagagcuggcggaacaacauccuccgcacccaggaguccgagugcgcgugcgucaacgggagcugcuucacggugaugaccgacggcccguccaacgggcaggccagcuacaagaucuucaagauggagaagggcaagguggucaaguccguggagcuggacgcccccaacuaccacuacgaggagugcagcugcuaccccgacgccggcgagaucacgugcgugugccgggacaacuggcacggguccaaccgccccugggucagcuucaaccagaaccuggaguaccagaucggcuacaucugcuccgggguguucggcgacaacccgcggcccaacgacgggaccggcagcugcggccccaugucccccaacggggccuacggcgugaagggguucagcuucaaguacggcaacggggucuggaucggccgcaccaaguccaccaacagccgguccggcuucgagaugaucugggacccgaacggguggaccggcaccgacagcagcuucuccgugaagcaggacaucguggcgaucacggacuggagcggguacuccggcagcuucguccagcaccccgagcucaccgggcuggacugcauccgccccugcuucuggguggagcugauccggggccgccccaaggaguccaccaucuggaccagcggcuccaucaucagcuucugcggggucaacuccgacacggugagcugguccuggccggacggcgccgagcuccccuucaccaucgacaaguga

SEQ ID NO: 76416 - RNA, 1350 nt, Artificial Sequence
  derived and/or modified sequence opt1 from neuraminidase__InfluenzaA__ABI36358
augaaccccaaccagaagaucaucaccaucggcagcaucugcauggugaucgggaucgucucccugaugcuccagaucggcaacaugaucagcaucugggugucccacagcgugcagaccgggaaccagcaccaggccgaguccaucagcaacacgaacccgcugaccgagaaggccgucgcguccgugacccuggccggcaacagcucccucugccccauccgcgggugggccgugcacagcaaggacaacaacauccggaucggcuccaagggcgacgucuucgugauccgcgagcccuucaucagcugcucccaccuggagugccggaccuucuuccugacgcagggggcccuccugaacgacaagcacagcaacggcaccgugaaggaccgcagcccccaccggacccugaugagcugcccggucggggaggcccccucccccuacaacagccgcuucgaguccguggcguggagcgccagcgccugccacgacggcaccuccuggcucacgaucgggaucagcggccccgacaacgaggccguggcgguccugaaguacaacggcaucaucaccgacaccaucaaguccuggcggaacaacauccugcgcacccaggagagcgagugcgccugcgugaacggguccugcuucacggugaugaccgacggcccgagcaacgggcaggccuccuacaagaucuucaagauggagaagggcaaggucgugaaguccguggagcucgacgcccccaacuaccacuacgaggagugcuccugcuaccccgacgccggcgagaucacgugcgucugccgggacaacuggcacgggagcaaccgccccuggguguccuucaaccagaaccuggaguaccagaucggcuacaucugcagcgggguguucggcgacaacccgcggcccaacgacgggaccggcuccugcggccccaugagccccaacggggcguacggcgucaagggguucuccuucaaguacggcaacgggguguggaucggccgcaccaagagcaccaacucccggagcggcuucgagaugaucugggacccgaacggguggaccggcaccgacuccagcuucagcgugaagcaggacaucgucgccaucacggacugguccggguacagcggcuccuucgugcagcaccccgagcugaccgggcucgacugcauccgccccugcuucugggucgagcugauccggggccgccccaaggagagcaccaucuggaccuccggcagcuccaucagcuucugcggggugaacuccgacacggugagcugguccuggccggacggcgccgagcugcccuucaccaucgacaaguga

SEQ ID NO: 76417 - RNA, 1350 nt, Artificial Sequence; identical to SEQ ID NO: 76407
  derived and/or modified sequence opt1 from neuraminidase__InfluenzaA__ABI36369

SEQ ID NO: 76418 - RNA, 1350 nt, Artificial Sequence
  derived and/or modified sequence opt1 from neuraminidase__InfluenzaA__ABI36391
augaaccccaaccagaagaucaucaccaucggcagcaucugcauggugaucgggaucgucucccugaugcuccagaucggcaacaugaucagcaucugggugucccacagcacccagaaggggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacgaggccguggcggugcugaaguacaacggcaucaucaccgacaccaucaaguccuggcggaacaacauccugcgcacccaggagagcgagugcgccugcgucaacggguccugcuucacggugaugaccgacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggaucuucggcgacaacccgcggcccaacgacgggaccggcuccugcggccccauguuccccaacggggcguacggcgugaagggguucagcuucaaguacggcaacgggguguggaucggccgcaccaaguccaccaacagccgguccggcuucgagaugaucugggacccgaacggguggaccggcaccgacagcuccuucagcgucaagcaggacaucguggccaucacggacuggagcggguacuccggcagcuucgugcagcaccccgagcugaccgggcucgacugcauccgccccugcuucugggucgagcugauccggggccgccccaaggaguccaccaucuggaccagcggcuccagcaucuccuucugcggggugaacagcgacacggucuccuggagcuggccggacggcgccgagcugcccuucaccaucgacaaguga

SEQ ID NO: 76419 - RNA, 1350 nt, Artificial Sequence; identical to SEQ ID NO: 76418
  derived and/or modified sequence opt1 from neuraminidase__InfluenzaA__ABI36402

SEQ ID NO: 76420 - RNA, 1350 nt, Artificial Sequence; identical to SEQ ID NO: 76407
  derived and/or modified sequence opt1 from neuraminidase__InfluenzaA__ABI36413

SEQ ID NO: 76421 - RNA, 1350 nt, Artificial Sequence
  derived and/or modified sequence opt1 from neuraminidase__InfluenzaA__ABI36446
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacgaggccguggcggugcugaaguacaacggcaucaucaccgacaccaucaaguccuggcggaacaacauccugcgcacccaggagagcgagugcgccugcgucaacggguccugcuucacggugaugaccgacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccuggaucuccuucaaccagaaccuggaguaccagaucggcuacaucugcagcggggucuucggcgacaacccgcggcccaacgacgggaccggcuccugcggccccaugagccccaacggggcguacggcgugaagggguucuccuucaaguacggcaacgggguguggaucggccgcaccaagagcaccaacucccggagcggcuucgagaugaucugggacccgaacggguggaccggcaccgacuccagcuucagcgucaagcaggacaucguggccaucacggacugguccggguacagcggcuccuucgugcagcaccccgagcugaccgggcucgacugcauccgccccugcuucugggucgagcugauccggggccgccccaaggagagcaccaucuggaccuccggcagcuccaucagcuucugcggggugaacuccgacacggucagcugguccuggccggacggcgccgagcugcccuucaccaucgacaaguga

SEQ ID NO: 76422 - RNA, 1350 nt, Artificial Sequence; identical to SEQ ID NO: 76411
  derived and/or modified sequence opt1 from neuraminidase__InfluenzaA__ABI36457

SEQ ID NO: 76423 - RNA, 1350 nt, Artificial Sequence
  derived and/or modified sequence opt1 from neuraminidase__InfluenzaA__ABI36476
augaaccccaaccagaagaucaucaccaucggcagcaucugcauggugaucgggaucgucucccugaugcuccagaucggcaacaugaucagcaucugggugucccacagcacccagaaggggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacgaggccguggcggugcugaaguacaacggcaucaucaccgacaccaucaaguccuggcggaacaacauccugcgcacccaggagagcgagugcgccugcgucaacggguccugcuucacggugaugaccgacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucacggacugguccggguacagcggcuccuucguccagcaccccgagcugaccgggcucgacugcauccgccccugcuucuggguggagcugauccggggccgccccaaggagagcaccaucuggaccuccggcagcuccaucagcuucugcggggucaacuccgacacggugagcugguccuggccggacggcgccgagcugcccuucaccaucgacaaguga

SEQ ID NO: 76424 - RNA, 1350 nt, Artificial Sequence
  derived and/or modified sequence opt1 from neuraminidase__InfluenzaA__ABI49409
augaaccccaaccgcaagaucaucaccaucggcagcaucugcauggugaucgggauggucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgggggugggccgugcacagcaaggacaacaacauccgcaucggcuccaagggcgacguguucgucauccgggagcccuucaucagcugcucccaccuggagugccgcaccuucuuccugacgcagggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacgaggccguggcggugcugaaguacaacggcaucaucaccgacaccaucaaguccuggcgcaacaacauccugcggacccaggagagcgagugcgccugcgucaacggguccugcuucacggugaugaccgacggcccgagcaacgggcaggccuccuacaagaucuucaagauggagaagggcaagguggucaagagcguggagcucguggcccccaacuaccacuacgaggagugcuccugcuaccccgacgccggcgagaucacgugcgucugccgcgacaacuggcacgggagcaaccggcccuggguguccuucaaccagaaccuggaguaccagaucggcuacaucugcagcgggguguucggcgacaacccgcgccccaacgacgggaccggcuccugcggccccaugagccccaacggggcguacggcgucaagggguucuccuucaaguacggcaacgggguguggaucggccggaccaagagcaccaacucccgcagcggcuucgagaugaucugggacccgaacggguggaccggcaccgacuccagcuucagcgugaagcaggacaucgucgccaucacggacugguccggguacagcggcuccuucgugcagcaccccgagcugaccgggcucgacugcauccggcccugcuucugggucgagcugauccgcggccggcccaaggagagcaccaucuggaccuccggcagcuccaucagcuucugcggggugaacuccgacacggccagcugguccuggccggacggcgccgagcugcccuucaccaucgacaaguga

SEQ ID NO: 76425 - RNA, 1350 nt, Artificial Sequence
  derived and/or modified sequence opt1 from neuraminidase__InfluenzaA__ABI49417
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcgcggggcccuccugaacgacaagcacagcaacggcaccgugaaggaccggagcccccaccgcacccugauguccugcccggugggggaggcccccucccccuacaacagccgguucgaguccgucgcguggagcgccagcgccugccacgacggcaccuccuggcucacgaucgggaucagcggccccgacaacgaggccguggcggugcugaaguacaacggcaucaucaccgacaccaucaaguccuggcgcaacaacauccugcggacccaggagagcgagugcgccugcgucaacggguccugcuucacggugaugaccgacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgcgacaacuggcacgggagcaaccggcccugggucuccuucaaccagaaccuggaguaccagaucggcuacaucugcagcgggguguucggcgacaacccgcgccccaacgacgggaccggcuccugcggccccaugagccccaacggggcguacggcgugaagggguucuccuucaaguacggcaacggggucuggaucggccggaccaagagcaccaacucccgcagcggcuucgagaugaucugggacccgaacggguggaccggcaccgacuccagcuucagcgugaagcaggacaucguggccaucacggacugguccggguacagcggcuccuucguccagcaccccgagcugaccgggcucgacugcauccggcccugcuucuggguggagcugauccgcggccagcccaaggagagcaccaucuggaccuccggcagcuccaucagcuucugcggggucaacuccgacacggugagcugguccuggccggacggcgccgagcugcccuucaccaucgacaaguga

SEQ ID NO: 76426 - RNA, 1410 nt, Artificial Sequence
  derived and/or modified sequence opt1 from neuraminidase__InfluenzaA__ABI84962
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggacagccgguccggguacgagaccuucaaggucaucggcggguggagcacccccaacuccaagagccaggugaaccgccaggucaucguggacaacaacaacugguccggcuacagcgggaucuucagcguggagggcaaguccugcaucaaccggugcuucuacgucgagcugauccgcggccgcccccaggagacccgggugugguggaccagcaacuccaucguggucuucugcgggaccagcggcacguacgggaccggcuccuggcccgacggggccaacaucaacuucaugccgaucuga

SEQ ID NO: 76427 - RNA, 1410 nt, Artificial Sequence
  derived and/or modified sequence opt1 from neuraminidase__InfluenzaA__ABI85003
augaaccccaaccagaagaucaucaccaucggcguggucaacaccacgcugagcaccaucgcccuccugaucggggugggcaaccugguguucaacaccgucauccacgagaagaucggggaccaccagaucgugacccacccgacgaucaugacccccgaggugcccaacugcuccgacaccaucaucaccuacaacaacacggucaucaacaacaucaccaccaccaucaucacggaggccgagcgccccuucaagagcccgcucccccugugccccuuccggggcuucuuccccuuccacaaggacaacgcgauccgccugggggagaacaaggacgugaucgugacccgggagccguacgucuccugcgacaacgacaacugcuggagcuucgcccucgcccagggcgcccugcugggcaccaagcacuccaacgggaccaucaaggaccgcacgcccuaccggagccucauccgcuuccccaucggcaccgcccccgugcuggggaacuacaaggagaucugcaucgcgugguccagcuccagcugcuucgacggcaaggaguggaugcacgugugcaugaccgggaacgacaacgacgccuccgcccagaucaucuacggcggccggaugaccgacagcaucaaguccuggcgcaaggacauccugcggacgcaggagagcgagugccagugcaucgacgggaccugcgucguggccgugaccgacggcccggcggccaacuccgccgaccaccgcgucuacuggauccgggaggggcgcaucaucaaguacgagaacgugcccaagaccaagauccagcaccucgaggagugcagcugcuacguggacaucgacgucuacugcaucugccgggacaacuggaagggcuccaaccgccccuggaugcggaucaacaacgagacgauccuggagaccggcuacgugugcagcaaguuccacuccgacacgccccgcccggccgaccccagcaucaugagcugcgacucccccagcaacgugaacgggggccccggggucaagggcuucggguucaaggccggcaacgacguguggcugggccggaccguguccaccagcgggcgcuccggcuucgagaucaucaaggucaccgagggguggaucaacagcccgaaccacgugaaguccaucacccagacccucgucagcaacaacgacugguccggcuacagcggguccuucaucgugaaggcgaaggacugcuuccagcccugcuucuacguggagcugauccggggccgccccaacaagaacgacgacgucagcuggacguccaacagcaucgugaccuucugcggccuggacaacgagcccggguccggcaacuggccggacgggagcaacaucggcuucaugcccaaguga

SEQ ID NO: 76428 - RNA, 1410 nt, Artificial Sequence; identical to SEQ ID NO: 76098
  derived and/or modified sequence opt1 from neuraminidase__InfluenzaA__ABI92294

SEQ ID NO: 76429 - RNA, 1413 nt, Artificial Sequence
  derived and/or modified sequence opt1 from neuraminidase__InfluenzaA__ABI92305
augaaccccaaccagaagaucaucaccaucggcagcaucugcauggccaucgggaucaucucccugauccuccagaucggcaacaucaucagcaucugggugucccaccugauccagaccgggagccagaaccacacgggcaucugcaaccagcgcaucaucaccuacgagaacuccaccugggucaaccagaccuacgugaacaucaacaacacgaacguggucgccgggaaggacaccaccagcgugacccuggcgggcaacuccagccucugcccggugcggggcugggccaucuacuccaaggacaacagcauccgcaucggguccaagggcgacgucuucgugauccgggagcccuucaucagcugcucccaccuggagugccgcacguucuuccugacccagggggcccuccugaacgacaagcacagcaacggcaccgugaaggaccggucccccuaccgcgcccugaugagcugccccaucggggaggccccgucccccuacaacagccgguucgaguccgucgcguggagcgccagcgccugccacgacggcaugggcuggcucaccaucgggaucuccggccccgacgacggggccguggcggugcugaaguacaacggcaucaucacggagaccaucaagagcuggcgcaagcggauccugcgcacccaggaguccgagugcgucugcaucaacggcagcugcuucaccaucaugacggacgggcccuccaacggcccggccagcuaccggaucuucaagaucgagaaggggaagaucaccaaguccaucgagcucgacgcccccaacagccacuacgaggagugcuccugcuaccccgacaccggcaccgugaugugcgugugccgcgacaacuggcacgggagcaaccggcccugggucuccuucaaccagaaccuggacuaccagaucggcuacaucugcagcggcguguucggggacaacccgcgccccaaggacggcaagggguccugcggccccgugacggucgacggggccgacggcgugaagggcuucagcuaccgguacgggaacggcguguggaucgggcgcaccaaguccaacagcucccggaagggcuucgagaugaucugggaccccaacggguggaccgacaccgacagcaacuuccuggucaagcaggacgugguggccaugacggacugguccggcuacagcggcagcuucguccagcacccggagcucaccgggcuggacugcaugcgccccugcuucuggguggagcugauccggggccgcccccgggagaagaccaccaucuggacguccgggagcuccaucagcuucugcggcgucaacuccgacaccgugaacuggagcuggcccgacggcgcggagcucccguucaccaucgacaaguga

SEQ ID NO: 76430 - RNA, 1413 nt, Artificial Sequence
  derived and/or modified sequence opt1 from neuraminidase__InfluenzaA__ABI92316
augaaccccaaccagaagaucaucaccaucggcagcaucuccaucgccaucggggugaucagccugauccuccagaucggcaacaucaucuccaucugggccagccacuccauccagaccgggagccagaaccacacgggcaucugcaaccagcgcaucaucaccuacgagaacuccaccugggucaaccagaccuacgugaacaucaacaacacgaacguggucgcggggaaggacaagaccagcaugacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccagcaacggcgccgccuccuaccgcaucuucaagaucgagaaggggcgggucaccaagagcaucgagcuggacgccccgaacuaccacuacgaggagugcuccugcuaccccgacaccggcaccgugaugugcgugugccgcgacaacuggcacgggagcaaccggcccugggucuccuucaaccagaaccuggacuaccagaucggcuacaucugcagcggcguguucggggacaacccccgcccgaaggacggcgagggguccugcaaccccgugacggucgacggcgcggacggggugaagggcuucagcuaccgguacggcaacgggguguggaucggccgcaccaaguccaaccggcuccgcaagggguucgagaugaucugggaccccaacggcuggaccgacaccgacagcgacuucuccaugaagcaggacaucgucgccaugacggacuggagcggguacuccggcagcuucgugcagcaccccgagcugaccggccuggacugcaugcggccgugcuucuggguggagcucguccgcgggcugccccgggagaacaccaccaucuggacgagcggcuccagcaucuccuucugcggggugaacagcgacaccgccaacugguccuggcccgacggcgccgagcugcccuucaccaucgacaaguga

SEQ ID NO: 76431 - RNA, 1410 nt, Artificial Sequence; identical to SEQ ID NO: 76109
  derived and/or modified sequence opt1 from neuraminidase__InfluenzaA__ABI92327

SEQ ID NO: 76432 - RNA, 1410 nt, Artificial Sequence
  derived and/or modified sequence opt1 from neuraminidase__InfluenzaA__ABI92338
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucaucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggacgagcaacagcaucguggucuucugcggcaccuccgggaccuacggcaccgggagcuggccggacggcgccgacaucaaccugaugcccaucuga

SEQ ID NO: 76433 - RNA, 1410 nt, Artificial Sequence
  derived and/or modified sequence opt1 from neuraminidase__InfluenzaA__ABI92349
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcgaaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggaucgggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76434 - RNA, 1410 nt, Artificial Sequence; identical to SEQ ID NO: 75335
  derived and/or modified sequence opt1 from neuraminidase__InfluenzaA__ABI92360

SEQ ID NO: 76435 - RNA, 1410 nt, Artificial Sequence; identical to SEQ ID NO: 75335
  derived and/or modified sequence opt1 from neuraminidase__InfluenzaA__ABI92371

SEQ ID NO: 76436 - RNA, 1413 nt, Artificial Sequence; identical to SEQ ID NO: 75394
  derived and/or modified sequence opt1 from neuraminidase__InfluenzaA__ABI92382

SEQ ID NO: 76437 - RNA, 1410 nt, Artificial Sequence; identical to SEQ ID NO: 75722
  derived and/or modified sequence opt1 from neuraminidase__InfluenzaA__ABI92393

SEQ ID NO: 76438 - RNA, 1410 nt, Artificial Sequence; identical to SEQ ID NO: 75335
  derived and/or modified sequence opt1 from neuraminidase__InfluenzaA__ABI92404

SEQ ID NO: 76439 - RNA, 1410 nt, Artificial Sequence
  derived and/or modified sequence opt1 from neuraminidase__InfluenzaA__ABI92415
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaacuucaugcccaucuga

SEQ ID NO: 76440 - RNA, 1410 nt, Artificial Sequence; identical to SEQ ID NO: 75722
  derived and/or modified sequence opt1 from neuraminidase__InfluenzaA__ABI92426

SEQ ID NO: 76441 - RNA, 1410 nt, Artificial Sequence; identical to SEQ ID NO: 75722
  derived and/or modified sequence opt1 from neuraminidase__InfluenzaA__ABI92437

SEQ ID NO: 76442 - RNA, 1410 nt, Artificial Sequence; identical to SEQ ID NO: 75722
  derived and/or modified sequence opt1 from neuraminidase__InfluenzaA__ABI92448

SEQ ID NO: 76443 - RNA, 1410 nt, Artificial Sequence; identical to SEQ ID NO: 75722
  derived and/or modified sequence opt1 from neuraminidase__InfluenzaA__ABI92459

SEQ ID NO: 76444 - RNA, 1410 nt, Artificial Sequence
  derived and/or modified sequence opt1 from neuraminidase__InfluenzaA__ABI92470
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgagaaggcggacaccaagauccuguucaucgaggaggggaagaucguccacacgagcagccuguccggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccuggaccccaacaacgaggagggcgggcacggcgucaaggggugggccuucgacgacggcaacgacguguggaugggccggaccaucagcgagaagcugcgcuccggguacgagaccuucaaggucaucgagggcuggagcaagcccaacuccaagcuccagaucaaccgccaggugaucguggaccgggggaaccggagcggcuacuccgggaucuucagcgucgagagcaaguccugcaucaaccgcugcuucuacguggagcugauccggggccgcaagcaggagaccgaggugcuguggaccagcaacuccaucgucguguucugcggcaccagcgggaccuacggcacgggguccuggccggacggcgccgacaucaaccucaugcccaucuga

SEQ ID NO: 76445 - RNA, 1410 nt, Artificial Sequence; identical to SEQ ID NO: 75738
  derived and/or modified sequence opt1 from neuraminidase__InfluenzaA__ABI92481

SEQ ID NO: 76446 - RNA, 1410 nt, Artificial Sequence; identical to SEQ ID NO: 75738
  derived and/or modified sequence opt1 from neuraminidase__InfluenzaA__ABI92492

SEQ ID NO: 76447 - RNA, 1410 nt, Artificial Sequence
  derived and/or modified sequence opt1 from neuraminidase__InfluenzaA__ABI92503
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggaggaguaccggaacugguccaagccgcagugcaacaucaccggguucgcgcccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacgagaacgcgaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggccgacaccaagauccuguucaucgaggagggcaagaucguccacacgagcagccuguccgggagcgcgcagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 76448 - RNA, 1410 nt, Artificial Sequence
  derived and/or modified sequence opt1 from neuraminidase__InfluenzaA__ABI92514
augaaccccaaccagaagaucaucaccaucggcagcgugucccugaccaucgccacgaucugcuuccucguccagaucgccauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccagcuccagcugccacgacgggaaggcguggcugcacgugugcgugaccggcgacgacgagaacgccaccgccuccuucaucuacgacgggcggcuggucgacagcaucggcuccuggagcaagaagauccuccgcacccaggaguccgagugcgugugcaucaacgggacgugcaccguggucaugaccgacggcagcgccuccggccgggcggacaccaagauccuguucaucgaggaggggaagaucgugcacacgagcaagcugagcggcuccgcccagcacguggaggagugcagcugcuacccccgcuaccccgggguccggugcgugugccgcgacaacuggaagggcuccaaccggccgaucguggacaucaacgucaaggacuacagcaucguguccagcuacgugugcuccggccucgucggggacacgccccgcaagaacgacagcuccagcuccagccacugccuggaccccaacaacgaggagggcgggcacggcgugaaggggugggccuucgacgacggcgacgacgucuggaugggccggaccaucuccgagaagucccgcagcggguacgagaccuucaaggugaucgagggcuggagcaagcccaacuccaagcugcagaucaaccgccaggugaucgucgagcgggggaacaugagcggcuacuccgggaucuucagcguggagggcaagagcugcaucaaccggugcuucuacguggagcucauccgcggccggaagcaggagaccgaggucugguggaccuccaacagcaucgugguguucugcgggaccuccggcaccuacgggacgggcagcuggccggacggggccgacaucaaccugaugcccaucuga

SEQ ID NO: 76449 - RNA, 1410 nt, Artificial Sequence
  derived and/or modified sequence opt1 from neuraminidase__InfluenzaA__ABI92525
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggaccuacggcacggggagcuggccggacggcgccgacaucaaccugaugcccaucuga

SEQ ID NO: 76450 - RNA, 1410 nt, Artificial Sequence
  derived and/or modified sequence opt1 from neuraminidase__InfluenzaA__ABI92536
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcgccgggagcuggccggacggcgccgacaucaaccugaugcccaucuga

SEQ ID NO: 76451 - RNA, 1410 nt, Artificial Sequence
  derived and/or modified sequence opt1 from neuraminidase__InfluenzaA__ABI92547
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcgccgggagcuggccggacggcgccgacaucaaccugaugcccaucuga

SEQ ID NO: 76452 - RNA, 1410 nt, Artificial Sequence
  derived and/or modified sequence opt1 from neuraminidase__InfluenzaA__ABI92558
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacuggucccgcccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggaccuacggcacggggagcuggccggacggcgccgacaucaaccugaugcccaucuga

SEQ ID NO: 76453 - RNA, 1410 nt, Artificial Sequence
  derived and/or modified sequence opt1 from neuraminidase__InfluenzaA__ABI92569
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggcaagcugguggacagcaucggguccuggagcaagaagauccuccggacccaggaguccgagugcgucugcaucaacggcacgugcgccguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagacggaggugugguggaccagcaacagcaucgucguguucugcggcaccuccgggaccuacggcacggggagcuggccggacggcgccgacaucaaccugaugcccaucuga

SEQ ID NO: 76454 - RNA, 1410 nt, Artificial Sequence
  derived and/or modified sequence opt1 from neuraminidase__InfluenzaA__ABI92580
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaacaaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaggggugcaucaaccggugcuucuacguggagcugauccgcggccggaaggaggagaccgaggugugguggaccuccaacagcaucgucguguucugcgggaccagcggcaccuacgggacgggcuccuggccggacggcgccgacaucaaccugaugcccaucuga

SEQ ID NO: 76455 - RNA, 1410 nt, Artificial Sequence
  derived and/or modified sequence opt1 from neuraminidase__InfluenzaA__ABI92591
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccuccgcacgcgccaggugugcaucgccugguccagcuccagcugccacgacgggaaggcguggcugcacgucugcgugaccggcgacgacgagaacgccaccgccuccuucaucuacaacgggcggcugguggacagcaucggcuccuggagcaagaagauccuccggacccaggaguccgagugcgucugcaucaacgggacgugcaccguggugaugaccgacggcagcgccuccggcaaggcggacaccaagauccuguucaucgaggaggggaagaucguccacaucagcacgcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagccuguccagcucccacugccuggaccccaacaacgaggagggcgggcacggcgucaaggggugggccuucgacgacggcaacgacguguggaugggccggaccaucagcgagaagcuccgcuccggguacgagaccuucaaggucaucgagggcuggagcaagcccaacuccaagcugcagaucaaccgccaggugaucguggagcgggggaaccggagcggcuacuccgggaucuucagcgucgagggcaagggcugcaucaaccgcugcuucuacguggagcugauccgggggcgcaaggaggagaccgaggugugguggaccuccaacagcaucgucguguucugcggcaccagcgggaccuacggcacgggguccuggccggacggcgccgacaucaaccucaugcccaucuga

SEQ ID NO: 76456 - RNA, 1410 nt, Artificial Sequence
  derived and/or modified sequence opt1 from neuraminidase__InfluenzaA__ABI92602
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccucccugaucuacaacggccggcucguggacagcaucggguccuggagcaagaagauccugcgcacccaggaguccgagugcgucugcaucaacggcacgugcaccguggugaugaccgacggcagcgccuccgggaaggcggacaccaagauccuguucaucgaggagggcaagaucguccacaucagcacgcucagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcuggugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcuccgguccggcuacgagaccuucaaggucaucgagggguggagcaagcccaacuccaagcuccaggugaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 76457 - RNA, 1410 nt, Artificial Sequence
  derived and/or modified sequence opt1 from neuraminidase__InfluenzaA__ABI92613
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacaacgagaacgccaccgccuccuucaucuacaacggcaagcugguggacagcaucggguccuggagcaagaagauccuccggacccaggaguccgagugcgucugcaucaacggcacgugcgccguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagacggaggugugguggaccagcaacagcaucgucguguucugcggcaccuccgggaccuacggcacggggagcuggccggacggcgccgacaucaaccugaugcccaucuga

SEQ ID NO: 76458 - RNA, 1410 nt, Artificial Sequence
  derived and/or modified sequence opt1 from neuraminidase__InfluenzaA__ABI92624
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugauccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgccugguccagcuccagcugccacgacggcaaggcguggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgccuccgggaaggcggacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 76459 - RNA, 1410 nt, Artificial Sequence
  derived and/or modified sequence opt1 from neuraminidase__InfluenzaA__ABI92635
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaaccucaccggguucgcccccuucuccaaggacaacagcauccgccuguccgccggcggggacaucugggugacccgggagcccuacgugagcugcgacccggacaagugcuaccaguucgcccugggccaggggaccacgcucaacaacggccacuccaacgacaccguccacgaccgcacccccuaccggacccugcugaugaacgagcucggcgugcccuuccaccuggggacgcgccaggugugcaucgccuggagcuccagcuccugccacgacggcaaggcguggcugcacgucugcgugaccggggacgacgagaacgccaccgccagcuucaucuacaacggccggcucguggacuccaucgggagcugguccaagaagauccugcgcacccaggagagcgagugcgucugcaucaacggcacgugcaccguggugaugaccgacggcuccgccagcgggaaggcggacaccaagaucaucuucaucgaggagggcaagaucguccacacguccacccugagcgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacagcaagcuccagaccaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcacgagcgggaccuacggcaccggguccuggcccgacggcgccgacaucaaccugaugcccaucuga

SEQ ID NO: 76460 - RNA, 1410 nt, Artificial Sequence; identical to SEQ ID NO: 75153
  derived and/or modified sequence opt1 from neuraminidase__InfluenzaA__ABI92646

SEQ ID NO: 76461 - RNA, 1410 nt, Artificial Sequence; identical to SEQ ID NO: 75153
  derived and/or modified sequence opt1 from neuraminidase__InfluenzaA__ABI92657

SEQ ID NO: 76462 - RNA, 1410 nt, Artificial Sequence
  derived and/or modified sequence opt1 from neuraminidase__InfluenzaA__ABI92668
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcggccccgacaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccagcuccagcugccacgacgggaaggcguggcugcacgucugcgugaccggcgacgacaagaacgccaccgccuccuucaucuacaacgggcggcugguggacagcaucggcuccuggagcaagaagauccuccgcacccaggaguccgagugcgucugcaucaacggcacgugcaccguggugaugaccgacgggagcgccuccggcaaggcggacaccaagauccuguucaucgaggaggggaagaucguccacaucagcacgcugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggaccagcaacagcaucgucguguucugcgggaccuccggcaccuacgggacgggcagcuggccggacggcgccgacaucaaccugaugcccaucuga

SEQ ID NO: 76463 - RNA, 1410 nt, Artificial Sequence; identical to SEQ ID NO: 75599
  derived and/or modified sequence opt1 from neuraminidase__InfluenzaA__ABI92679

SEQ ID NO: 76464 - RNA, 1410 nt, Artificial Sequence; identical to SEQ ID NO: 75153
  derived and/or modified sequence opt1 from neuraminidase__InfluenzaA__ABI92701

SEQ ID NO: 76465 - RNA, 1410 nt, Artificial Sequence
  derived and/or modified sequence opt1 from neuraminidase__InfluenzaA__ABI92712
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggcgaugcucugcgagcccacgaccaccgagcgcaacaccacggagaucguguaccugaccaacaccaccaucgagaaggagaucugccccaagcuggucgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgccugguccagcuccagcugccacgacggcaaggcguggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgccuccgggaaggcggacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 76466 - RNA, 1410 nt, Artificial Sequence
  derived and/or modified sequence opt1 from neuraminidase__InfluenzaA__ABI92723
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacaagaacgcgaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcucgucggcgacacgccccgcaagaacgacagcuucuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccgccaggugaucgucgagcggggcaaccggagcggguacuccggcaucuucagcguggagggcaaguccugcaucaaccgcugcuucuacguggagcugauccgggggcgcaaggaggagaccgaggucugguggaccagcaacagcaucgugguguucugcggcaccuccgggaccuacggcacggggagcuggccggacggcgccgacaucaaccugaugcccaucuga

SEQ ID NO: 76467 - RNA, 1410 nt, Artificial Sequence; identical to SEQ ID NO: 75153
  derived and/or modified sequence opt1 from neuraminidase__InfluenzaA__ABI92734

SEQ ID NO: 76468 - RNA, 1410 nt, Artificial Sequence; identical to SEQ ID NO: 75599
  derived and/or modified sequence opt1 from neuraminidase__InfluenzaA__ABI92745

SEQ ID NO: 76469 - RNA, 1410 nt, Artificial Sequence
  derived and/or modified sequence opt1 from neuraminidase__InfluenzaA__ABI92756
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugauccucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76470 - RNA, 1410 nt, Artificial Sequence
  derived and/or modified sequence opt1 from neuraminidase__InfluenzaA__ABI92767
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggagaagaccgaggugugguggaccagcaacagcaucgucguguucugcggcaccuccgggaccuacggcacggggagcuggccggacggcgccgacaucaaccugaugcccaucuga

SEQ ID NO: 76471 - RNA, 1410 nt, Artificial Sequence; identical to SEQ ID NO: 75153
  derived and/or modified sequence opt1 from neuraminidase__InfluenzaA__ABI92778

SEQ ID NO: 76472 - RNA, 1410 nt, Artificial Sequence; identical to SEQ ID NO: 75335
  derived and/or modified sequence opt1 from neuraminidase__InfluenzaA__ABI92789

SEQ ID NO: 76473 - RNA, 1410 nt, Artificial Sequence; identical to SEQ ID NO: 75335
  derived and/or modified sequence opt1 from neuraminidase__InfluenzaA__ABI92800

SEQ ID NO: 76474 - RNA, 1410 nt, Artificial Sequence; identical to SEQ ID NO: 75335
  derived and/or modified sequence opt1 from neuraminidase__InfluenzaA__ABI92811

SEQ ID NO: 76475 - RNA, 1410 nt, Artificial Sequence; identical to SEQ ID NO: 75335
  derived and/or modified sequence opt1 from neuraminidase__InfluenzaA__ABI92822

SEQ ID NO: 76476 - RNA, 1410 nt, Artificial Sequence; identical to SEQ ID NO: 75335
  derived and/or modified sequence opt1 from neuraminidase__InfluenzaA__ABI92844

SEQ ID NO: 76477 - RNA, 1410 nt, Artificial Sequence; identical to SEQ ID NO: 75335
  derived and/or modified sequence opt1 from neuraminidase__InfluenzaA__ABI92855

SEQ ID NO: 76478 - RNA, 1410 nt, Artificial Sequence
  derived and/or modified sequence opt1 from neuraminidase__InfluenzaA__ABI92866
augaaccccaaccagaagaucaucaccaucggcagcgccucccugaccaucgccacgaucugcuuccucauccagaucgcgauccuggugaccaccgucacccugcacuucaagcagcacgagugcaacagccucccgaacaaccaggugaugcugugcgagcccacgaucaucgagcgcaacaucaccgagaucguguaccugaccaacaccacgaucgagaaggagaucugccccaagcucgccgaguaccggaacugguccaagccccagugcaacaucaccggguucgccccguucagcaaggacaacuccauccgccugagcgccggcggggacaucugggucacccgggagcccuacguguccugcgaccccgacaagugcuaccaguucgcccugggccaggggaccacgcucaacaacggccacagcaacgacaccgugcacgaccgcacccccuaccggacccugcugaugaacgagcucggcgucccguuccaccuggggacgcgccaggugugcaucgcgugguccagcuccagcugccacgacggcaaggccuggcugcacgugugcgucaccggggacgacaagaacgccaccgccuccuucaucuacaacggccggcucguggacagcaucuccagcugguccaagaagauccugcgcacccaggagagcgagugcgugugcaucaacgggacgugcaccgucgugaugaccgacggcuccgcgagcggcaaggccgacaccaagauccuguucaucgaggaggggaagaucauccacaucagcacgcucuccggcagcgcccagcacguggaggagugcuccugcuacccccgguaccccgggguccgcugcgugugccgggacaacuggaagggcagcaaccgccccaucguggacaucaacgucaaggacuacuccaucgugagcuccuacgugugcagcggccuggucggggacaccccgcggaagaacgacuccuucagcuccagccacugccuggaccccaacaacgaggagggcgggcacggcgugaaggggugggccuucgacgacggcaacgacguguggaugggccgcaccaucuccgagaagcuccggagcggguacgagaccuucaaggucaucgagggcugguccaaccccaacagcaagcugcagaucaaccgccaggugaucgucgagcgggggaaccgcuccggcuacagcgggaucuucuccguggagggcaagagcugcaucaaccggugcuucuacguggagcugauccgcggccggaaggaggagacggaggucugguggaccagcaacuccaucgugguguucugcgggaccagcggcaccuacgggacgggcuccuggcccgacggggccgacaucaaccucaugccgaucuga

SEQ ID NO: 76479 - RNA, 1410 nt, Artificial Sequence; identical to SEQ ID NO: 75335
  derived and/or modified sequence opt1 from neuraminidase__InfluenzaA__ABI92877

SEQ ID NO: 76480 - RNA, 1410 nt, Artificial Sequence; identical to SEQ ID NO: 75335
  derived and/or modified sequence opt1 from neuraminidase__InfluenzaA__ABI92888

SEQ ID NO: 76481 - RNA, 1410 nt, Artificial Sequence; identical to SEQ ID NO: 75335
  derived and/or modified sequence opt1 from neuraminidase__InfluenzaA__ABI92899

SEQ ID NO: 76482 - RNA, 1410 nt, Artificial Sequence; identical to SEQ ID NO: 75335
  derived and/or modified sequence opt1 from neuraminidase__InfluenzaA__ABI92910

SEQ ID NO: 76483 - RNA, 1410 nt, Artificial Sequence; identical to SEQ ID NO: 75335
  derived and/or modified sequence opt1 from neuraminidase__InfluenzaA__ABI92921

SEQ ID NO: 76484 - RNA, 1410 nt, Artificial Sequence; identical to SEQ ID NO: 75335
  derived and/or modified sequence opt1 from neuraminidase__InfluenzaA__ABI92932

SEQ ID NO: 76485 - RNA, 1410 nt, Artificial Sequence; identical to SEQ ID NO: 75722
  derived and/or modified sequence opt1 from neuraminidase__InfluenzaA__ABI92943

SEQ ID NO: 76486 - RNA, 1410 nt, Artificial Sequence; identical to SEQ ID NO: 75722
  derived and/or modified sequence opt1 from neuraminidase__InfluenzaA__ABI92954

SEQ ID NO: 76487 - RNA, 1410 nt, Artificial Sequence
  derived and/or modified sequence opt1 from neuraminidase__InfluenzaA__ABI92965
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgaccgguccagcuccagccacugccucgaccccaacaacgaggagggcgggcacggggucaagggcugggccuucgacgacgggaacgacguguggaugggccgcaccaucuccgagaagcugcggagcggcuacgagaccuucaaggucaucgaggggugguccaaccccaacagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 76488 - RNA, 1410 nt, Artificial Sequence; identical to SEQ ID NO: 75722
  derived and/or modified sequence opt1 from neuraminidase__InfluenzaA__ABI92976

SEQ ID NO: 76489 - RNA, 1410 nt, Artificial Sequence; identical to SEQ ID NO: 75722
  derived and/or modified sequence opt1 from neuraminidase__InfluenzaA__ABI92987

SEQ ID NO: 76490 - RNA, 1410 nt, Artificial Sequence; identical to SEQ ID NO: 75722
  derived and/or modified sequence opt1 from neuraminidase__InfluenzaA__ABI92998

SEQ ID NO: 76491 - RNA, 1410 nt, Artificial Sequence; identical to SEQ ID NO: 75926
  derived and/or modified sequence opt1 from neuraminidase__InfluenzaA__ABI93009

SEQ ID NO: 76492 - RNA, 1410 nt, Artificial Sequence; identical to SEQ ID NO: 75722
  derived and/or modified sequence opt1 from neuraminidase__InfluenzaA__ABI93020

SEQ ID NO: 76493 - RNA, 1413 nt, Artificial Sequence; identical to SEQ ID NO: 76364
  derived and/or modified sequence opt1 from neuraminidase__InfluenzaA__ABI93031

SEQ ID NO: 76494 - RNA, 1410 nt, Artificial Sequence; identical to SEQ ID NO: 76119
  derived and/or modified sequence opt1 from neuraminidase__InfluenzaA__ABI93042

SEQ ID NO: 76495 - RNA, 1410 nt, Artificial Sequence; identical to SEQ ID NO: 75292
  derived and/or modified sequence opt1 from neuraminidase__InfluenzaA__ABI93053

SEQ ID NO: 76496 - RNA, 1410 nt, Artificial Sequence
  derived and/or modified sequence opt1 from neuraminidase__InfluenzaA__ABI93064
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacacgagcaagcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucuccgagaagucccgcagcggguacgagaccuucaaggucaucgagggcuggagcaagcccaacuccaagcugcagaucaaccgccaggugaucguggagcgggggaaccggagcggcuacuccgggaucuucagcgucgagggcaagagcugcaucaaccgcugcuucuacguggagcucauccggggccgcaagcaggagaccgaggugugguggaccuccaacagcaucgucguguucugcgggaccuccggcaccuacgggacgggcagcuggccggacggggccgacaucaaccugaugcccaucuga

SEQ ID NO: 76497 - RNA, 1410 nt, Artificial Sequence; identical to SEQ ID NO: 75738
  derived and/or modified sequence opt1 from neuraminidase__InfluenzaA__ABI93075

SEQ ID NO: 76498 - RNA, 1410 nt, Artificial Sequence; identical to SEQ ID NO: 75738
  derived and/or modified sequence opt1 from neuraminidase__InfluenzaA__ABI93086

SEQ ID NO: 76499 - RNA, 1410 nt, Artificial Sequence; identical to SEQ ID NO: 75738
  derived and/or modified sequence opt1 from neuraminidase__InfluenzaA__ABI93097

SEQ ID NO: 76500 - RNA, 1410 nt, Artificial Sequence
  derived and/or modified sequence opt1 from neuraminidase__InfluenzaA__ABI93108
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaacgacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 76501 - RNA, 1410 nt, Artificial Sequence
  derived and/or modified sequence opt1 from neuraminidase__InfluenzaA__ABI93119
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacaacuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagcccaacagcaagcuccagaucaaccgccaggugaucguggaccgguccaaccggagcggcuacuccgggaucuucagcgucgagagcaaguccugcaucaaccgcugcuucuacguggagcugauccggggccgcaagcaggagaccgaggugcuguggaccagcaacuccaucgucguguucugcggcaccagcgggaccuacggcacgggguccuggccggacggcgccgacaucaaccucaugcccaucuga

SEQ ID NO: 76502 - RNA, 1416 nt, Artificial Sequence
  derived and/or modified sequence opt1 from neuraminidase__InfluenzaA__ABI94584
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaaccugaccugcaccacgaucaaccagaacaacaccaccgucguggagaacaccuacgugaacaacacgaccaucaucaccaagggcaccgaccucaagacgcccagcuaccugcugcucaacaagucccugugcaacgucgagggguggguggugaucgccaaggacaacgccguccgcuucggcgagagcgagcagaucaucgugacccgggagcccuacguguccugcgaccccaccggcugcaagauguacgcccugcaccaggggaccacgauccgcaacaagcacagcaacggcaccauccacgaccggaccgccuuccgcgggcucaucuccaccccgcugggcacgccgcccaccgucagcaacuccgacuucaugugcgugggguggagcuccacgaccugccacgacggcaucgcgcggaugaccaucugcauccagggcaacaacgacaacgccaccgccaccguguacuacaaccgccggcugaccacgaccaucaagaccugggcccgcaacauccuccggacccaggagagcgagugcgucugccacaacgggacgugcgcgguggugaugaccgacggcuccgccagcucccaggccuacaccaaggucauguacuuccacaaggggcugguggugaaggaggaggagcugcgcggcagcgcccggcacaucgaggagugcuccugcuacggccacaaccagaaggugaccugcgucugccgcgacaacuggcagggggccaaccggcccaucaucgagaucgacaugagcacgcucgagcacaccagccgcuacgugugcaccggcauccugaccgacacgucccggcccggggacaagagcuccggcgacugcagcaaccccaucaccgggucccccggcguccccggcgugaagggguucggcuuccugaacggggacaacaccuggcucggccgcaccaucagcccgcggucccgcagcggguucgagaugcugaagauccccaacgcgggcaccgaccccaacucccggaucgccgagcgccaggagaucgucgacaacaacaacuggagcggcuacuccgggagcuucaucgacuacuggaacgacaacuccgagugcuacaaccccugcuucuacguggagcugauccggggccgcccggaggaggccaaguacguguggugggccagcaacucccucaucgcccugugcgggagccccuuccccgucggcuccgggagcuuccccgacggcgcgcagauccaguacuucuccuga

SEQ ID NO: 76503 - RNA, 1413 nt, Artificial Sequence; identical to SEQ ID NO: 75836
  derived and/or modified sequence opt1 from neuraminidase__InfluenzaA__ABI95220

SEQ ID NO: 76504 - RNA, 1410 nt, Artificial Sequence
  derived and/or modified sequence opt1 from neuraminidase__InfluenzaA__ABI95242
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcgaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 76505 - RNA, 1413 nt, Artificial Sequence
  derived and/or modified sequence opt1 from neuraminidase__InfluenzaA__ABI95253
augaaccccaaccagaagaucaucaccaucggcagcaucuccaucgccaucgggaucaucagcaucaugcugcagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccucgccggcaacuccagccugugcuccaucagcggcugggccaucuacaccaaggacaacuccauccggaucgggagcaagggcgacguguucgugauccgcgagccguucaucuccugcagccaccuggagugccggacguucuuccucacccagggggcccugcugaacgacaagcacuccaacggcaccgucaaggaccgcagccccuaccgggcccucauguccugcccccugggggaggcgcccagcccguacaacagcaaguucgaguccguggccuggagcgccuccgccugccacgacggcaugggcuggcugaccaucgggaucagcggccccgacaacggggcgguggccguccucaaguacaacggcaucaucacggagaccaucaaguccuggaagaagcgcauccugcggacccaggagagcgagugcgugugcgugaacggcuccugcuucaccaucaugacggacgggcccagcgacggcgccgccuccuacaagaucuucaagaucgagaaggggaaggucaccaagagcaucgagcugaacgcccccaacucccacuacgaggagugcagcugcuacccggacaccggcaccgugaugugcgugugccgcgacaacuggcacggguccaaccggcccugggucagcuucaaccagaaccucgacuaccagaucggcuacaucugcuccggcguguucggggacaacccccgccccaaggacggcgaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcugaccggccucgacugcauccgccccugcuucuggguggagcugguccgggggcgcccgcgggagaacaccaccaucuggacguccggcagcuccaucagcuucugcggggugaacuccgacaccgccaacuggagcuggcccgacggcgccgagcugcccuucaccaucgacaaguga

SEQ ID NO: 76506 - RNA, 1413 nt, Artificial Sequence; identical to SEQ ID NO: 76364
  derived and/or modified sequence opt1 from neuraminidase__InfluenzaA__ABI95264

SEQ ID NO: 76507 - RNA, 1413 nt, Artificial Sequence; identical to SEQ ID NO: 76364
  derived and/or modified sequence opt1 from neuraminidase__InfluenzaA__ABI95275

SEQ ID NO: 76508 - RNA, 1413 nt, Artificial Sequence; identical to SEQ ID NO: 76364
  derived and/or modified sequence opt1 from neuraminidase__InfluenzaA__ABI95286

SEQ ID NO: 76509 - RNA, 1413 nt, Artificial Sequence
  derived and/or modified sequence opt1 from neuraminidase__InfluenzaA__ABI95297
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaagaaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 76510 - RNA, 1410 nt, Artificial Sequence; identical to SEQ ID NO: 75738
  derived and/or modified sequence opt1 from neuraminidase__InfluenzaA__ABI95308

SEQ ID NO: 76511 - RNA, 1413 nt, Artificial Sequence; identical to SEQ ID NO: 75394
  derived and/or modified sequence opt1 from neuraminidase__InfluenzaA__ABI96131

SEQ ID NO: 76512 - RNA, 1413 nt, Artificial Sequence; identical to SEQ ID NO: 75394
  derived and/or modified sequence opt1 from neuraminidase__InfluenzaA__ABI96133

SEQ ID NO: 76513 - RNA, 1413 nt, Artificial Sequence; identical to SEQ ID NO: 75394
  derived and/or modified sequence opt1 from neuraminidase__InfluenzaA__ABI96136

SEQ ID NO: 76514 - RNA, 1410 nt, Artificial Sequence
  derived and/or modified sequence opt1 from neuraminidase__InfluenzaA__ABJ09110
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucauccacacgagcagccuguccgggagcgcccagcacgucgaggagugcuccugcuacccccgcuaccccggcgugcggugcgugugccgcgacaacuggaagggcagcaaccggccgaucgucgacaucaacgugaaggacuacuccaucgugagcuccuacgucugcagcgggcucgugggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccggcaggucaucguggaccgcggcaaccggagcggguacuccggcaucuucagcguggagagcaaguccugcaucaaccgcugcuucuacgucgagcugauccggggccgcaagcaggagaccgaggugcuguggaccagcaacuccaucguggucuucugcgggaccagcggcaccuacgggacgggcuccuggccggacggggccgacaucaaccucaugcccaucuga

SEQ ID NO: 76515 - RNA, 1410 nt, Artificial Sequence; identical to SEQ ID NO: 76109
  derived and/or modified sequence opt1 from neuraminidase__InfluenzaA__ABJ09143

SEQ ID NO: 76516 - RNA, 1413 nt, Artificial Sequence; identical to SEQ ID NO: 75933
  derived and/or modified sequence opt1 from neuraminidase__InfluenzaA__ABJ09154

SEQ ID NO: 76517 - RNA, 1410 nt, Artificial Sequence; identical to SEQ ID NO: 75335
  derived and/or modified sequence opt1 from neuraminidase__InfluenzaA__ABJ09165

SEQ ID NO: 76518 - RNA, 1410 nt, Artificial Sequence; identical to SEQ ID NO: 75335
  derived and/or modified sequence opt1 from neuraminidase__InfluenzaA__ABJ09176

SEQ ID NO: 76519 - RNA, 1410 nt, Artificial Sequence; identical to SEQ ID NO: 75722
  derived and/or modified sequence opt1 from neuraminidase__InfluenzaA__ABJ09198

SEQ ID NO: 76520 - RNA, 1410 nt, Artificial Sequence; identical to SEQ ID NO: 75722
  derived and/or modified sequence opt1 from neuraminidase__InfluenzaA__ABJ09209

SEQ ID NO: 76521 - RNA, 1410 nt, Artificial Sequence
  derived and/or modified sequence opt1 from neuraminidase__InfluenzaA__ABJ09220
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcgaaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcgcggcaccacgcugaacaaccggcacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccgccugguggacagcaucggguccuggagcaagaacauccuccggacccaggaguccgagugcgucugcaucaacggcacgugcaccguggugaugaccgacggcagcgccuccgagcgcgcggacaccaagauccuguucaucgaggaggggaagaucguccacaucagcccccugagcggcuccgcccagcacguggaggagugcagcugcuacccccgguacccgggggugcgcugcgucugccgggacaacuggaagggcuccaaccgccccaucguggacaucaacgugaaggacuacagcaucgucuccagcuacgugugcuccggccucgugggggacacgccccggaagaacgacagcuccagcuccagcuacugccgcaaccccaacaacgagaagggcucccacggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccgcggccggaagcaggagaccgaggugugguggacguccaacagcaucgucguguucugcgggaccuccggcaccuacgggaccggcagcuggcccgacggggccgacaucaaccugaugcccaucuga

SEQ ID NO: 76522 - RNA, 1410 nt, Artificial Sequence; identical to SEQ ID NO: 75738
  derived and/or modified sequence opt1 from neuraminidase__InfluenzaA__ABJ09231

SEQ ID NO: 76523 - RNA, 1410 nt, Artificial Sequence; identical to SEQ ID NO: 75738
  derived and/or modified sequence opt1 from neuraminidase__InfluenzaA__ABJ09242

SEQ ID NO: 76524 - RNA, 1410 nt, Artificial Sequence; identical to SEQ ID NO: 75292
  derived and/or modified sequence opt1 from neuraminidase__InfluenzaA__ABJ09253

SEQ ID NO: 76525 - RNA, 1410 nt, Artificial Sequence
  derived and/or modified sequence opt1 from neuraminidase__InfluenzaA__ABJ09264
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuacaugaccaacaccacgaucgagaaggagaucugccccaagcuggcggaguaccggaacugguccaagccgcagugcaacaucaccggguucgcccccuucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggaccccguaccgcacccugcucaugaacgagcugggcgugcccuuccaccugggcacgaagcaggucugcaucgccugguccagcuccagcugccacgacgggaaggcguggcuccacgugugcgugaccggccacgacgagaacgccaccgccuccuucaucuacaacgggcggcugguggacagcaucggcuccuggagcaagaagauccugcgcacccaggaguccgagugcgucugcaucaacgggacgugcaccguggugaugaccgacggcagcgccuccggcaaggcggacaccaagauccucuucaucgaggaggggaagaucguccacaucagcccccugagcggcuccgcccagcacguggaggagugcagcugcuacccccgguacccgggggugcgcugcgucugccgggacaacuggaagggcuccaaccgccccaucguggacaucaacgugaaggacuacagcaucgucuccagcuacgugugcuccggccuggugggggacacgccccggaagaacgacagcuccagcuccagccacugccucaaccccaacaacgaggagggcgggcacggcgucaaggggugggccuucgacgacggcaacgacguguggaugggccgcaccaucuccgagaagcugcggagcggguacgagaccuucaaggucaucgagggcugguccaagccgaacagcaagcugcagaucaaccgccaggugaucguggaccgggggaacuccagcggcuacuccgggaucuucagcgucgagggcaagagcugcaucaaccgcugcuucuacguggagcucauccggggccgcaagcaggagaccgaggugugguggacguccaacagcaucgucgugcugugcgggaccuccggcaccuacgggaccggcagcuggcccgacggggccgacaucaaccugaugcccaucuga

SEQ ID NO: 76526 - RNA, 1410 nt, Artificial Sequence
  derived and/or modified sequence opt1 from neuraminidase__InfluenzaA__ABJ09286
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacagcaagcuccagaucaacaagcaggucaucguggaccggggcaaccgcuccggguacagcggcaucuucuccguggagggcaagagcugcaucaaccggugcuucuacguggagcugauccgcgggcggaagcaggagaccgaggugcuguggaccagcaacuccaucgucguguucugcggcaccagcgggaccuacggcacgggguccuggcccgacggcgccgacaucaaccucaugcccaucuga

SEQ ID NO: 76527 - RNA, 1410 nt, Artificial Sequence; identical to SEQ ID NO: 75292
  derived and/or modified sequence opt1 from neuraminidase__InfluenzaA__ABJ09308

SEQ ID NO: 76528 - RNA, 1410 nt, Artificial Sequence; identical to SEQ ID NO: 76496
  derived and/or modified sequence opt1 from neuraminidase__InfluenzaA__ABJ09319

SEQ ID NO: 76529 - RNA, 1413 nt, Artificial Sequence; identical to SEQ ID NO: 75961
  derived and/or modified sequence opt1 from neuraminidase__InfluenzaA__ABJ09330

SEQ ID NO: 76530 - RNA, 1410 nt, Artificial Sequence
  derived and/or modified sequence opt1 from neuraminidase__InfluenzaA__ABJ09341
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccugcucggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagagcaagagcugcaucaaccgcugcuucuacguggagcugauccggggccgcaagcaggagaccgaggugcucuggaccuccaacagcaucgucguguucugcgggaccuccggcaccuacgggacgggcagcuggccggacggggccgacaucaaccugaugcccaucuga

SEQ ID NO: 76531 - RNA, 1410 nt, Artificial Sequence
  derived and/or modified sequence opt1 from neuraminidase__InfluenzaA__ABJ09352
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgaagcaggucugcaucgccugguccagcuccagcugccacgacgggaaggcguggcugcacgugugcgugaccggcgacgacgagaacgccaccgccuccuucaucuacaacgggcgccugguggacagcaucggcuccuggagcaagaagauccuccggacccaggaguccgagugcgucugcaucaacggcacgugcaccguggugaugaccgacgggagcgccuccggcaaggcggacaccaagauccuguucaucgaggaggggaagaucguccacacgagcagccuguccggcagcgcccagcacguggaggagugcuccugcuacccccgcuaccccggcgugcggugcgucugccgcgacaacuggaaggggagcaaccggccgaucguggacaucaacgugaaggacuacuccaucgucagcuccuacgugugcagcggccucgugggggacacgccccgcaagaacgacuccagcuccagcucccacugccuggaccccaacaacgaggagggcgggcacggcgucaagggcugggccuucgacgacgggaacgacguguggaugggccggaccaucagcgagaagcugcgcuccggguacgagaccuucaaggucaucgagggcuggagcaagcccaacuccaagcuccagaucaaccgccaggugaucguggaccgggggaaccggagcggcuacuccggcaucuucagcgucgagagcaaguccugcaucaaccgcugcuucuacguggagcugauccgggggcgcaagcaggagaccgaggugcuguggaccagcaacuccaucgucguguucugcggcaccagcgggaccuacggcacgggguccuggccggacggcgccgacaucaaccucaugcccaucuga

SEQ ID NO: 76532 - RNA, 1407 nt, Artificial Sequence
  derived and/or modified sequence opt1 from neuraminidase__InfluenzaA__ABJ09374
augauccagagcaagaucaucaccaucggcuccgugagccugaccaucuccacgaucugcuucuucaugcagaucgccauccucaucaccaccgucacccugcacuucaagcaguacgaguucaacagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcacccccuaccggacccugcucaugaacgagcugggcgugccguuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaagaagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggcccaucguggacaucaacaucaaggacuacagcaucgucuccagcuacgugugcuccggccuggugggcgacaccccgcgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagacguucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcucauccggggcaagaaggaggagaccgaggugcuguggaccagcaacuccaucgucguguucugcggcaccagcgggacguacggcaccggguccuggcccgacggcgccgacaucaaccugaugccgaucuga

SEQ ID NO: 76533 - RNA, 1410 nt, Artificial Sequence; identical to SEQ ID NO: 75722
  derived and/or modified sequence opt1 from neuraminidase__InfluenzaA__ABJ09385

SEQ ID NO: 76534 - RNA, 1410 nt, Artificial Sequence; identical to SEQ ID NO: 75261
  derived and/or modified sequence opt1 from neuraminidase__InfluenzaA__ABJ16590

SEQ ID NO: 76535 - RNA, 1410 nt, Artificial Sequence; identical to SEQ ID NO: 76526
  derived and/or modified sequence opt1 from neuraminidase__InfluenzaA__ABJ16601

SEQ ID NO: 76536 - RNA, 1413 nt, Artificial Sequence
  derived and/or modified sequence opt1 from neuraminidase__InfluenzaA__ABJ16612
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccgucgggaucagcggccccgacaacggggcgguggccgugcugaaguacaacggcaucaucacggagaccaucaaguccuggaagaagcgcauccugcggacccaggagagcgagugcgucugcgugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucguccagcaccccgagcucaccggccuggacugcauccgccccugcuucuggguggagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 76537 - RNA, 1410 nt, Artificial Sequence; identical to SEQ ID NO: 76526
  derived and/or modified sequence opt1 from neuraminidase__InfluenzaA__ABJ16623

SEQ ID NO: 76538 - RNA, 1410 nt, Artificial Sequence
  derived and/or modified sequence opt1 from neuraminidase__InfluenzaA__ABJ16634
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaucugccccaagcuggccgaguaccggaacuggagcaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 76539 - RNA, 1413 nt, Artificial Sequence; identical to SEQ ID NO: 75394
  derived and/or modified sequence opt1 from neuraminidase__InfluenzaA__ABJ16656

SEQ ID NO: 76540 - RNA, 1413 nt, Artificial Sequence; identical to SEQ ID NO: 75394
  derived and/or modified sequence opt1 from neuraminidase__InfluenzaA__ABJ16667

SEQ ID NO: 76541 - RNA, 1413 nt, Artificial Sequence
  derived and/or modified sequence opt1 from neuraminidase__InfluenzaA__ABJ16678
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuuccucgucaagcaggacgugguggccaucacggacugguccggguacagcggcagcuucguccagcaccccgagcugaccggccuggacugcauccgccccugcuucuggguggagcucguccgggggcugccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 76542 - RNA, 1413 nt, Artificial Sequence; identical to SEQ ID NO: 75394
  derived and/or modified sequence opt1 from neuraminidase__InfluenzaA__ABJ16689

SEQ ID NO: 76543 - RNA, 1410 nt, Artificial Sequence
  derived and/or modified sequence opt1 from neuraminidase__InfluenzaA__ABJ16700
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggcaagaagcaggagaccgaggugcuguggaccagcaacuccaucgucguguucugcgggaccagcggcaccuacgggacgggcuccuggccggacggggccgacaucaaccucaugcccaucuga

SEQ ID NO: 76544 - RNA, 1410 nt, Artificial Sequence
  derived and/or modified sequence opt1 from neuraminidase__InfluenzaA__ABJ16711
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcucgugggcgacacgccccgcaagaacgacuccagcuccagcucccacugccuggaccccaacaacgaggagggcgggcacggggugaagggcugggccuucgacgacggcaacgacgccuggauggggcggaccaucagcgagaagcugcgcuccggcuacgagaccuucaaggucaucgagggguggagcaaguccaacagcaagcuccagaucaaccgccaggugaucgucgaccggggcaaccgguccggguacagcggcaucuucagcguggagggcaaguccugcaucaaccgcugcuucuacguggagcugauccgggggcgcaagcaggagaccgagguccuguggaccagcaacuccaucgugguguucugcggcaccagcgggaccuacggcacgggguccuggcccgacggcgccgacaucaaccucaugccgaucuga

SEQ ID NO: 76545 - RNA, 1413 nt, Artificial Sequence
  derived and/or modified sequence opt1 from neuraminidase__InfluenzaA__ABJ16733
augaaccccaaccagaagaucaucaccaucggcagcaucuccguggccaucgggaucaucaaccugauccuccagaucggcaacaucaucagcaucugggccucccacagcauccagaccgggucccagaacuacacgggcaucugcaaccagcgcaucaucaccuacgagaaccggaccugggucaaccagaccuacgugaacaucaacaacacgaacguggucgcggggaaggacaagaccagcaugacccuggccggcaacuccagccugugcccgauccgcggcugggccaucuacaccaaggacaacuccauccggaucgggagcaagggcgacaucuucgugauccgcgagcccuucaucuccugcagccaccucgagugccggacguucuuccugacccagggggcccugcucaacgacaagcacuccaacggcaccaucaaggaccgcagccccuuccgggcccugauguccugcccccugggggaggcgccgagccccuacaacucccgcuucgagagcguggccugguccgccagcgccugccacgacggccucggcuggcugaccaucgggaucagcggccccgacaacggggcggucgccgugcugaaguacaacggcaucaucacggagaccaucaaguccuggaagaagcagauccuccggacccaggagagcgagugcgugugcgucaacggcuccugcuucaccaucaugacggacgggcccagcaaccgcgccgccuccuaccggaucuucaagaucgagaagggccgcgugaccaagagcaucgagcuggacgccccgaacuaccacuacgaggagugcuccugcuaccccgacaccgggaccgugaugugcgucugccgggacaacuggcacggcagcaaccgccccuggguguccuucaaccagaaccuggacuaccagaucggguacaucugcagcggcguguucggcgacaacccccggccgaaggacggggagggcuccugcaaccccgucacgguggacggggcggacggcgugaagggguucagcuaccgcuacggcaacggcgucuggaucgggcggaccaaguccaaccgccuccggaagggcuucgagaugaucugggaccccaacggguggaccgacaccgacagcgacuucuccaugaagcaggacgugguggccaugacggacuggagcggcuacuccgggagcuucguccagcaccccgagcugaccggccuggacugcaugcgcccgugcuucuggguggagcucgugcggggccugccccgcgagaacaccaccaucuggacguccgggagcagcaucuccuucugcggcgucaacagcgagaccgccaacugguccuggcccgacggggccgagcugcccuucaccaucgacaaguga

SEQ ID NO: 76546 - RNA, 1410 nt, Artificial Sequence; identical to SEQ ID NO: 75738
  derived and/or modified sequence opt1 from neuraminidase__InfluenzaA__ABJ16744

SEQ ID NO: 76547 - RNA, 1410 nt, Artificial Sequence; identical to SEQ ID NO: 75738
  derived and/or modified sequence opt1 from neuraminidase__InfluenzaA__ABJ16755

SEQ ID NO: 76548 - RNA, 1410 nt, Artificial Sequence; identical to SEQ ID NO: 75738
  derived and/or modified sequence opt1 from neuraminidase__InfluenzaA__ABJ16766

SEQ ID NO: 76549 - RNA, 1410 nt, Artificial Sequence
  derived and/or modified sequence opt1 from neuraminidase__InfluenzaA__ABJ16777
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcucgugggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugcuguggaccuccaacagcaucguggucuucugcggcaccuccgggaccuacggcacggggagcuggccggacggcgccgacaucaaccucaugcccaucuga

SEQ ID NO: 76550 - RNA, 1410 nt, Artificial Sequence; identical to SEQ ID NO: 75738
  derived and/or modified sequence opt1 from neuraminidase__InfluenzaA__ABJ16788

SEQ ID NO: 76551 - RNA, 1413 nt, Artificial Sequence; identical to SEQ ID NO: 75976
  derived and/or modified sequence opt1 from neuraminidase__InfluenzaA__ABJ53441

SEQ ID NO: 76552 - RNA, 1413 nt, Artificial Sequence
  derived and/or modified sequence opt1 from neuraminidase__InfluenzaA__ABJ53452
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugaucgcggggaaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacggagaccaucaaguccuggaagaagcgcauccugcggacccaggagagcgagugcgucugcgugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcaacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 76553 - RNA, 1410 nt, Artificial Sequence; identical to SEQ ID NO: 75720
  derived and/or modified sequence opt1 from neuraminidase__InfluenzaA__ABJ53463

SEQ ID NO: 76554 - RNA, 1410 nt, Artificial Sequence; identical to SEQ ID NO: 75720
  derived and/or modified sequence opt1 from neuraminidase__InfluenzaA__ABJ53474

SEQ ID NO: 76555 - RNA, 1410 nt, Artificial Sequence
  derived and/or modified sequence opt1 from neuraminidase__InfluenzaA__ABJ53485
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaacagcaacuccaagcuccagaccaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcacguccgggaccuacggcaccgggagcuggcccgacggcgccgacaucaaccucaugccgaucuga

SEQ ID NO: 76556 - RNA, 1413 nt, Artificial Sequence; identical to SEQ ID NO: 76364
  derived and/or modified sequence opt1 from neuraminidase__InfluenzaA__ABJ53496

SEQ ID NO: 76557 - RNA, 1413 nt, Artificial Sequence; identical to SEQ ID NO: 76364
  derived and/or modified sequence opt1 from neuraminidase__InfluenzaA__ABJ53507

SEQ ID NO: 76558 - RNA, 1413 nt, Artificial Sequence
  derived and/or modified sequence opt1 from neuraminidase__InfluenzaA__ABJ53518
augaaccccaaccagaagaucaucaccaucggcagcaucuccguggccaucgggaucaucaaccugauccuccagaucggcaacaucaucagcaucugggccucccacagcauccagaccgggucccagaacuacacgggcaucugcaaccagcgcaucaucaccuacgagaaccggaccugggucaaccagaccuacgugaacaucaacaacacgaacguggucgcggggaaggacaagaccagcaugacccuggccggcaaccugucccucugcccgauccgcggcugggccaucuacaccaaggacaacagcauccggaucggguccaagggcgacguguucgugauccgcgagcccuucaucagcugcucccaccuggagugccggacguucuuccugacccagggggcccuccugaacgacaagcacagcaacggcaccaucaaggaccgcucccccuuccgggcccugaugagcugcccccucggggaggcgccgucccccuacaacagccgcuucgaguccgucgccuggagcgccuccgccugccacgacggccugggcuggcugaccaucgggaucagcggccccgacaacggggcgguggccgugcucaaguacaacggcaucaucacggagaccaucaagagcuggaagaagcagauccugcggacccaggaguccgagugcgucugcgugaacggcagcugcuucaccaucaugacggacgggcccuccaaccgcgccgccagcuaccggaucuucaagaucgagaagggccgcgugaccaaguccaucgagcuggacgccccgaacuaccacuacgaggagugcagcugcuaccccgacaccgggaccgucaugugcgugugccgggacaacuggcacggcuccaaccgccccugggugagcuucaaccagaaccucgacuaccagaucggguacaucugcuccggcgucuucggcgacaacccccggccgaaggacggggagggcagcugcaaccccgugacgguggacggggcggacggcgucaagggguucuccuaccgcuacggcaacggcguguggaucgggcggaccaagagcaaccgccugcggaagggcuucgagaugaucugggaccccaacggguggaccgacaccgacuccgacuucagcaugaagcaggacguggucgccaugacggacugguccggcuacagcggguccuucgugcagcaccccgagcugaccggccucgacugcaugcgcccgugcuucuggguggagcugguccggggccugccccgcgagaacaccaccaucuggacgagcggguccagcaucagcuucugcggcgugaacuccgagaccgccaacuggagcuggcccgacggggccgagcuccccuucaccaucgacaaguga

SEQ ID NO: 76559 - RNA, 1410 nt, Artificial Sequence; identical to SEQ ID NO: 75162
  derived and/or modified sequence opt1 from neuraminidase__InfluenzaA__ABK39965

SEQ ID NO: 76560 - RNA, 1410 nt, Artificial Sequence
  derived and/or modified sequence opt1 from neuraminidase__InfluenzaA__ABK39976
augaaccccaaccagaagaucaucaccaucggcagcgugucccugaccaucagcacgaccugcuucuucaugcagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacgcaggagagcgagugcgugugcaucaacgggaccugcgccguggucaugaccgacggguccgccagcggcaaggcggacaccaagauccucuucaucgaggagggcaagaucgugcacacgagcacccuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76561 - RNA, 1410 nt, Artificial Sequence; identical to SEQ ID NO: 75720
  derived and/or modified sequence opt1 from neuraminidase__InfluenzaA__ABK39987

SEQ ID NO: 76562 - RNA, 1410 nt, Artificial Sequence; identical to SEQ ID NO: 75390
  derived and/or modified sequence opt1 from neuraminidase__InfluenzaA__ABK39998

SEQ ID NO: 76563 - RNA, 1410 nt, Artificial Sequence; identical to SEQ ID NO: 75335
  derived and/or modified sequence opt1 from neuraminidase__InfluenzaA__ABK40020

SEQ ID NO: 76564 - RNA, 1413 nt, Artificial Sequence
  derived and/or modified sequence opt1 from neuraminidase__InfluenzaA__ABK40031
augaaccccaaccagaagaucaucaccaucggcagcaucuccguggccaucgggaucaucaaccugauccuccagaucggcaacaucaucagcaucugggccucccacagcauccagaccgggucccagaacuacacgggcaucugcaaccagcgcaucaucaccuacgagaaccggaccugggucaaccagaccuacgugaacaucaacaacacgaacguggucgcggggaaggacaagaccagcaugacccuggccggcaacuccagccugugcccgauccgcggcugggccaucuacaccaaggacaacuccauccggaucgggagcaagggcgacguguucgugauccgcgagcccuucaucuccugcagccaccucgagugccggacguucuuccugacccagggggcccugcucaacgacaagcacuccaacggcaccaucaaggaccgcagccccuuccgggcccugauguccugcccccugggggaggcgccgagccccuacaacucccgcuucgagagcgucgccugguccgccagcgccugccacgacggccucggcuggcugaccaucgggaucagcggccccgacaacggggcgguggccgugcugaaguacaacggcaucaucacggagaccaucaaguccuggaagaagcagauccuccggacccaggagagcgagugcgucugcgugaacggcuccugcuucaccaucaugacggacgggcccagcaaccgcgccgccuccuaccggaucuucaagaucgagaagggccgcgugaccaagagcaucgagcuggacgccccgaacuaccacuacgaggagugcuccugcuaccccgacaccgggaccgucaugugcgugugccgggacaacuggcacggcagcaaccgccccuggguguccuucaaccagaaccuggacuaccagaucggguacaucugcagcggcgucuucggcgacaacccccggccgaaggacggggagggcuccugcaaccccgugacgguggacggggcggacggcgucaagggguucagcuaccgcuacggcaacggcguguggaucgggcggaccaaguccaaccgccuccggaagggcuucgagaugaucugggaccccaacggguggaccgacaccgacagcgacuucuccaugaagcaggacguggucgccaugacggacuggagcggcuacuccgggagcuucgugcagcaccccgagcugaccggccuggacugcaugcgcccgugcuucuggguggagcucguccggggccugccccgcgagaacaccaccaucuggacguccgggagcagcaucuccuucugcggcgugaacagcgagaccgccaacugguccuggcccgacggggccgagcugcccuucaccaucgacaaguga

SEQ ID NO: 76565 - RNA, 1413 nt, Artificial Sequence; identical to SEQ ID NO: 76564
  derived and/or modified sequence opt1 from neuraminidase__InfluenzaA__ABK40042

SEQ ID NO: 76566 - RNA, 1413 nt, Artificial Sequence; identical to SEQ ID NO: 76564
  derived and/or modified sequence opt1 from neuraminidase__InfluenzaA__ABK40053

SEQ ID NO: 76567 - RNA, 1410 nt, Artificial Sequence; identical to SEQ ID NO: 75738
  derived and/or modified sequence opt1 from neuraminidase__InfluenzaA__ABK40064

SEQ ID NO: 76568 - RNA, 1410 nt, Artificial Sequence; identical to SEQ ID NO: 75738
  derived and/or modified sequence opt1 from neuraminidase__InfluenzaA__ABK40078

SEQ ID NO: 76569 - RNA, 1413 nt, Artificial Sequence; identical to SEQ ID NO: 76067
  derived and/or modified sequence opt1 from neuraminidase__InfluenzaA__ABK40513

SEQ ID NO: 76570 - RNA, 1413 nt, Artificial Sequence; identical to SEQ ID NO: 76067
  derived and/or modified sequence opt1 from neuraminidase__InfluenzaA__ABK40538

SEQ ID NO: 76571 - RNA, 1413 nt, Artificial Sequence
  derived and/or modified sequence opt1 from neuraminidase__InfluenzaA__ABK40549
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccagcaacggcccggcguccuaccggaucuucaagaucgagaaggggaagaucaccaagagcaucgagcuggacgcccccaacucccacuacgaggagugcagcugcuaccccgacaccggcacggugaugugcgugugccgcgacaacuggcacggguccaaccggcccugggucagcuucaaccagaaccucgacuacaagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggaccgacacggacuccaacuuccuggucaagcaggacgugguggccaugaccgacuggagcggguacagcggcuccuucguccagcacccggagcugaccggccucgacugcaugcgccccugcuucuggguggagcugauccgggggcgcccccgggagaagaccacgaucuggaccagcggcuccagcaucuccuucugcggggucaacagcgacaccgccaacugguccuggcccgacggcgcggagcugccguucaccaucgacaaguga

SEQ ID NO: 76572 - RNA, 1413 nt, Artificial Sequence; identical to SEQ ID NO: 76067
  derived and/or modified sequence opt1 from neuraminidase__InfluenzaA__ABK40560

SEQ ID NO: 76573 - RNA, 1413 nt, Artificial Sequence; identical to SEQ ID NO: 76067
  derived and/or modified sequence opt1 from neuraminidase__InfluenzaA__ABK40571

SEQ ID NO: 76574 - RNA, 1413 nt, Artificial Sequence; identical to SEQ ID NO: 76067
  derived and/or modified sequence opt1 from neuraminidase__InfluenzaA__ABK40582

SEQ ID NO: 76575 - RNA, 1413 nt, Artificial Sequence
  derived and/or modified sequence opt1 from neuraminidase__InfluenzaA__ABK40593
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccagcaacggcccggcgucccaccggaucuucaagaucgagaaggggaagaucaccaagagcaucgagcuggacgcccccaacucccacuacgaggagugcagcugcuaccccgacaccggcacggugaugugcgugugccgcgacaacuggcacggguccaaccggcccugggucagcuucaaccagaaccucgacuacaagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggaccgacacggacuccaacuuccuggucaagcaggacgugguggccaugaccgacuggagcggguacagcggcuccuucguccagcacccggagcugaccggccucgacugcaugcgccccugcuucuggguggagcugauccgggggcgcccccgggagaagaccacgaucuggaccagcggcuccagcaucuccuucugcggggucaacagcgacaccgccaacugguccuggcccgacggcgcggagcugccguucaccaucgacaaguga

SEQ ID NO: 76576 - RNA, 1413 nt, Artificial Sequence; identical to SEQ ID NO: 76067
  derived and/or modified sequence opt1 from neuraminidase__InfluenzaA__ABK40604

SEQ ID NO: 76577 - RNA, 1410 nt, Artificial Sequence; identical to SEQ ID NO: 75738
  derived and/or modified sequence opt1 from neuraminidase__InfluenzaA__ABK40615

SEQ ID NO: 76578 - RNA, 1410 nt, Artificial Sequence; identical to SEQ ID NO: 75069
  derived and/or modified sequence opt1 from neuraminidase__InfluenzaA__ABK40626

SEQ ID NO: 76579 - RNA, 1410 nt, Artificial Sequence
  derived and/or modified sequence opt1 from neuraminidase__InfluenzaA__ABK40648
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcauccccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgccuccgaccgggcggacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggagcaagccgaacuccaagcugcagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugugguggacguccaacagcaucguggucuucugcggcaccuccgggaccuacggcaccgggagcuggcccgacggcgccgacaucaaccucaugcccaucuga

SEQ ID NO: 76580 - RNA, 1410 nt, Artificial Sequence; identical to SEQ ID NO: 76121
  derived and/or modified sequence opt1 from neuraminidase__InfluenzaA__ABK40659

SEQ ID NO: 76581 - RNA, 1410 nt, Artificial Sequence; identical to SEQ ID NO: 76109
  derived and/or modified sequence opt1 from neuraminidase__InfluenzaA__ABK40681

SEQ ID NO: 76582 - RNA, 1413 nt, Artificial Sequence
  derived and/or modified sequence opt1 from neuraminidase__InfluenzaA__ABK40692
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcguggagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcaagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 76583 - RNA, 1410 nt, Artificial Sequence; identical to SEQ ID NO: 75738
  derived and/or modified sequence opt1 from neuraminidase__InfluenzaA__ABK40703

SEQ ID NO: 76584 - RNA, 1410 nt, Artificial Sequence; identical to SEQ ID NO: 75738
  derived and/or modified sequence opt1 from neuraminidase__InfluenzaA__ABK40714

SEQ ID NO: 76585 - RNA, 1410 nt, Artificial Sequence; identical to SEQ ID NO: 75738
  derived and/or modified sequence opt1 from neuraminidase__InfluenzaA__ABK40725

SEQ ID NO: 76586 - RNA, 1410 nt, Artificial Sequence; identical to SEQ ID NO: 75738
  derived and/or modified sequence opt1 from neuraminidase__InfluenzaA__ABK40736

SEQ ID NO: 76587 - RNA, 1410 nt, Artificial Sequence; identical to SEQ ID NO: 76453
  derived and/or modified sequence opt1 from neuraminidase__InfluenzaA__ABK40747

SEQ ID NO: 76588 - RNA, 1413 nt, Artificial Sequence; identical to SEQ ID NO: 75959
  derived and/or modified sequence opt1 from neuraminidase__InfluenzaA__ABK79951

SEQ ID NO: 76589 - RNA, 1413 nt, Artificial Sequence; identical to SEQ ID NO: 76564
  derived and/or modified sequence opt1 from neuraminidase__InfluenzaA__ABK79973

SEQ ID NO: 76590 - RNA, 1410 nt, Artificial Sequence; identical to SEQ ID NO: 75738
  derived and/or modified sequence opt1 from neuraminidase__InfluenzaA__ABK79984

SEQ ID NO: 76591 - RNA, 1410 nt, Artificial Sequence; identical to SEQ ID NO: 75738
  derived and/or modified sequence opt1 from neuraminidase__InfluenzaA__ABK79995

SEQ ID NO: 76592 - RNA, 1413 nt, Artificial Sequence; identical to SEQ ID NO: 76067
  derived and/or modified sequence opt1 from neuraminidase__InfluenzaA__ABK80028

SEQ ID NO: 76593 - RNA, 1413 nt, Artificial Sequence; identical to SEQ ID NO: 76067
  derived and/or modified sequence opt1 from neuraminidase__InfluenzaA__ABK80039

SEQ ID NO: 76594 - RNA, 1413 nt, Artificial Sequence; identical to SEQ ID NO: 76067
  derived and/or modified sequence opt1 from neuraminidase__InfluenzaA__ABK80050

SEQ ID NO: 76595 - RNA, 1410 nt, Artificial Sequence
  derived and/or modified sequence opt1 from neuraminidase__InfluenzaA__ABK80061
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagucccgcagcggcuacgagaccuucaaggucaucgaggggugguccaagcccaacagcaagcugcagaucaaccgccaggugaucguggaccggggcaaccgguccggguacagcggcaucuucagcgucgagggcaaguccugcaucaaccgcugcuucuacguggagcucauccgggggcgcaagcaggagaccgaggugcuguggaccagcaacuccaucgucguguucugcggcaccagcgggaccuacggcacgggguccuggccggacggcgccgacaucaaccugaugcccaucuga

SEQ ID NO: 76596 - RNA, 1410 nt, Artificial Sequence; identical to SEQ ID NO: 75069
  derived and/or modified sequence opt1 from neuraminidase__InfluenzaA__ABK80072

SEQ ID NO: 76597 - RNA, 1410 nt, Artificial Sequence
  derived and/or modified sequence opt1 from neuraminidase__InfluenzaA__ABK80083
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccagcuccugccacgacggcaaggcguggcugcacgugugcgugaccggggacgacgagaacgccaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggcggacaccaagauccuguucaucgaggagggcaagaucguccacacgagccugcucuccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcuggugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcuccgcuccggcuacgagaccuucaaggucaucgagggguggagcaagcccaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcucuggaccuccaacagcaucgucguguucugcggcaccuccgggaccuacggcacggggagcuggccggacggcgccgacaucaaccugaugcccaucuga

SEQ ID NO: 76598 - RNA, 1410 nt, Artificial Sequence
  derived and/or modified sequence opt1 from neuraminidase__InfluenzaA__ABK80094
augaaccccaaccagaagaucaucaccaucggcagcgugucccugaucaucgccaccaucugcuuccucaugcagaucgccauccuggucacgaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccagcuccagcugccacgacggcaaggcguggcugcacgugugcgugacgggggacgacgagaacgccaccgccuccuucaucuacaacggccgccugguggacagcaucggguccuggagcaagaagauccuccggacccaggaguccgagugcgucugcaucaacgggaccugcacgguggugaugaccgacggcagcgccuccgggaaggcggacaccaagauccuguucaucgaggagggcaagaucguccacaccagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggacgagcaacuccaucgucguguucugcgggaccagcggcaccuacgggaccggcuccuggccggacggggccgacaucaaccucaugcccaucuga

SEQ ID NO: 76599 - RNA, 1410 nt, Artificial Sequence; identical to SEQ ID NO: 75738
  derived and/or modified sequence opt1 from neuraminidase__InfluenzaA__ABK80105

SEQ ID NO: 76600 - RNA, 1410 nt, Artificial Sequence
  derived and/or modified sequence opt1 from neuraminidase__InfluenzaA__ABK80138
augaaccccaaccagaagaucaucaccaucggcagcgugucccugaccaucgccacgaucugcuuccucaugcagaccgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacgcaggaguccgagugcgucugcaucaacgggaccugcaccguggugaugaccgacggcagcgccuccgggaaggcggacacgaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76601 - RNA, 1410 nt, Artificial Sequence
  derived and/or modified sequence opt1 from neuraminidase__InfluenzaA__ABK80149
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggcgaugcucuacgagcccacgaucaucgagcgcaacaucaccgagaucguguaccugaccaacaccacgaucgagaaggagaucugccccaagcuggccgaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgcgugguccagcuccagcugccacgacggcaaggccuggcugcacgugugcgucaccggggacgacgagaacgccaccgccuccuucaucuacaacggccggcugguggacagcaucggguccuggagcaagaagauccuccgcacccaggaguccgagugcgugugcaucaacggcacgugcaccgucgugaugaccgacggcagcgcguccgggaaggccgacaccaagauccuguucaucgaggagggcaagaucgugcacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggaccuacggcacggggagcuggccggacggcgccgacaucaaccugaugcccaucuga

SEQ ID NO: 76602 - RNA, 1410 nt, Artificial Sequence; identical to SEQ ID NO: 76601
  derived and/or modified sequence opt1 from neuraminidase__InfluenzaA__ABK80160

SEQ ID NO: 76603 - RNA, 1410 nt, Artificial Sequence
  derived and/or modified sequence opt1 from neuraminidase__InfluenzaA__ABK80171
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggagcuccagcuccugccacgacggcaaggcguggcugcacgucugcgugaccggggacgacgagaacgccaccgccagcuucaucuacaacggccggcugguggacuccaucgggagcugguccaagaagauccuccgcacccaggagagcgagugcgucugcaucaacggcacgugcaccguggugaugaccgacggcuccgccagcgggaaggcggacaccaagauccuguucaucgaggagggcaagaucguccacaucuccacgcugagcgggagcgcccagcacguggaggagugcuccugcuacccccgguacccgggcgugcgcugcgucugccgggacaacuggaagggcagcaaccgccccaucguggacaucaacgugaaggacuacuccaucuucagcuccuacgucugcagcgggcucgugggcgacacgccccggaagaacgacuccuucagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagccgaacagcaagcuccagaccaaccgccaggucaucguggagcggggcaaccgcuccggguacagcggcaucuucuccguggagggcaagagcugcaucaaccggugcuucuacgucgagcugauccgcgggcggaaggaggagaccgaggugugguggaccuccaacagcaucguggucuucugcggcaccagcgggacguacggcaccggguccuggcccgacggcgccgacaucaaccugaugcccaucuga

SEQ ID NO: 76604 - RNA, 1410 nt, Artificial Sequence
  derived and/or modified sequence opt1 from neuraminidase__InfluenzaA__ABK80182
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggcaagcugguggacagcaucggguccuggagcaagaagauccuccggacccaggaguccgagugcgucugcaucaacggcacgugcgccguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagacggaggugugguggaccagcaacagcaucgucguguucugcggcaccuccgggaccuacggcacggggagcuggccggacggcgccgacaucaaccugaugcccaucuga

SEQ ID NO: 76605 - RNA, 1410 nt, Artificial Sequence
  derived and/or modified sequence opt1 from neuraminidase__InfluenzaA__ABK80193
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucggcgagaagcugcggagcggguacgagaccuucaaggucaucgagggcugguccaagcccaacagcaagcuccagaccaaccgccaggugaucguggagcgggggaaccgcuccggcuacagcggcaucuucuccgucgagggcaagagcugcaucaaccggugcuucuacguggagcugauccgcgggcggaaggaggagaccgaggugugguggaccuccaacagcaucgucguguucugcgggaccagcggcacguacgggaccggcuccuggccggacggcgccgacaucaaccugaugcccaucuga

SEQ ID NO: 76606 - RNA, 1410 nt, Artificial Sequence
  derived and/or modified sequence opt1 from neuraminidase__InfluenzaA__ABK80204
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggcaagcugguggacagcaucggguccuggagcaagaagauccuccggacccaggaguccgagugcgucugcaucaacggcacgugcgccguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacgccuggauggggcggaccaucagcgagaagcugcgcuccggcuacgagaccuucaaggugaucgagggguggagcaagcccaacuccaagcuccagaccaaccggcaggucaucguggagcgcggcaaccggagcggguacuccggcaucuucagcguggagggcaaguccugcaucaaccgcugcuucuacgucgagcugauccgggggcgcaaggaggagacggaggugugguggaccagcaacagcaucguggucuucugcggcaccuccgggaccuacggcacggggagcuggccggacggcgcggacaucaaccugaugcccaucuga

SEQ ID NO: 76607 - RNA, 1410 nt, Artificial Sequence; identical to SEQ ID NO: 75599
  derived and/or modified sequence opt1 from neuraminidase__InfluenzaA__ABK80215

SEQ ID NO: 76608 - RNA, 1410 nt, Artificial Sequence; identical to SEQ ID NO: 75599
  derived and/or modified sequence opt1 from neuraminidase__InfluenzaA__ABK80226

SEQ ID NO: 76609 - RNA, 1410 nt, Artificial Sequence
  derived and/or modified sequence opt1 from neuraminidase__InfluenzaA__ABK80237
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaccgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggacguacggcaccgggagcuggccggacggcgccgacaucaaccugaugcccaucuga

SEQ ID NO: 76610 - RNA, 1410 nt, Artificial Sequence
  derived and/or modified sequence opt1 from neuraminidase__InfluenzaA__ABK80259
augaaccccaaccagaagaucaucaccaucggcagcgccucccugaccaucgccacgaucugcuuccucauccagaucgcgauccuggugaccaccgucacccugcacuucaagcagcacgagugcaacagcccgcccaacaaccaggugaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgcgugguccagcuccagcugccacgacggcaaggccuggcugcacgugugcgucaccggggacgacaagaacgccaccgccuccuucaucuacaacggccggcugguggacagcaucuccagcugguccaagaagauccuccgcacccaggagagcgagugcgugugcaucaacgggacgugcaccgucgugaugaccgacggcuccgcgagcggcaaggccgacaccaagauccuguucaucgaggaggggaagaucauccacaucagcacgcuguccggcagcgcccagcacguggaggagugcuccugcuacccccgguaccccgggguccgcugcgugugccgggacaacuggaagggcagcaaccgcccgaucguggacaucaacgucaaggacuacuccaucgugagcuccuacgugugcagcggccucgucggggacacgccccggaagaacgacuccuucagcuccagccacugccuggaccccaacaacgaggagggcgggcacggcgugaaggggugggccuucgacgacggcaacgacguguggaugggccgcaccaucuccgagaagcugcggagcggguacgagaccuucaaggucaucgagggcugguccaaccccaacagcaagcuccagaucaaccgccaggugaucgucgagcgggggaaccgcuccggcuacagcgggaucuucuccguggagggcaagagcugcaucaaccggugcuucuacguggagcugauccgcggccggaaggaggagaccgaggucugguggaccagcaacuccaucgugguguucugcgggaccagcggcaccuacgggacgggcuccuggccggacggggccgacaucaaccugaugcccaucuga

SEQ ID NO: 76611 - RNA, 1410 nt, Artificial Sequence; identical to SEQ ID NO: 75335
  derived and/or modified sequence opt1 from neuraminidase__InfluenzaA__ABK80270

SEQ ID NO: 76612 - RNA, 1410 nt, Artificial Sequence; identical to SEQ ID NO: 75722
  derived and/or modified sequence opt1 from neuraminidase__InfluenzaA__ABK80281

SEQ ID NO: 76613 - RNA, 1410 nt, Artificial Sequence
  derived and/or modified sequence opt1 from neuraminidase__InfluenzaA__ABK80292
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcagcaaccgguccggcuacagcgggaucuucagcguggagggcaaguccugcaucaaccgcugcuucuacgucgagcucauccgggggcgcaaggaggagaccgaggugcuguggaccagcaacuccaucguggucuucugcggcaccagcggcacguacgggaccggcuccuggccggacggggccgacaucaaccugaugcccaucuga

SEQ ID NO: 76614 - RNA, 1410 nt, Artificial Sequence
  derived and/or modified sequence opt1 from neuraminidase__InfluenzaA__ABK80303
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucuacgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcaacgccagcgggaaggcggacaccaagauccuguucaucgaggagggcaagaucguccacaucuccacgcugagcgggagcgcccagcacguggaggagugcuccugcuacccccgguaccccggcgugcgcugcgucugccgggacaacuggaagggcagcaaccgcccgaucguggacaucaacgugaaggacuacuccaucgucagcuccuacgugugcagcgggcucgugggcgacacgccccggaagaacgacuccuucagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcaccagcgggaccuacggcacgggguccuggccggacggcgccgacaucaaccugaugcccaucuga

SEQ ID NO: 76615 - RNA, 1410 nt, Artificial Sequence
  derived and/or modified sequence opt1 from neuraminidase__InfluenzaA__ABK80314
augaaccccaaccagaagaucaucaccaucggcagcgugucccugaccaucgccacgaucugcuuccucaugcagaucgccauccuggucaccaccgugacccugcacuucaagcaguacgagugcgacagcccgcccaacaaccaggugaugcucuacgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76616 - RNA, 1350 nt, Artificial Sequence
  derived and/or modified sequence opt1 from neuraminidase__InfluenzaA__ABL07021
augaaccccaaccagaagaucaucaccaucggcagcaucugcauggugaucgggaucgucucccugaugcuccagaucggcaacaugaucagcaucugggugucccacagcauccagaaggggaaccagcaccaggccgaguccaucagcaacaccaacccgcugacggagaaggccguggcguccaucacccuggccggcaacagcucccucugccccauccgcgggugggccguccacagcaaggacaacaacauccggaucggcuccaagggcgacguguucgugauccgcgagcccuucaucagcugcucccaccuggagugccggaccuucuuccugacccagggggcccuccugaacgacaagcacagcaacggcacggucaaggaccgcagcccccaccggacccugaugagcugcccggugggggaggcccccucccccuacaacagccgcuucgaguccguggcguggagcgccagcgccugccacgacggcaccuccuggcucaccaucgggaucagcggccccgacaacgaggccgucgcggugcugaaguacaacggcaucaucacggacaccaucaaguccuggcggaacaacauccugcgcacccaggagagcgagugcgccugcgugaacggguccugcuucaccgucaugacggacggcccgagcaacgggcaggccuccuacaagaucuucaagaugaagaagggcaagguggugaaguccgucgagcucgacgcccccaacuaccacuacgaggagugcuccugcuaccccgacgccggcgagaucacgugcgugugccgggacaacuggcacgggagcaaccgccccuggguguccuucaaccagaaccuggaguaccagaucggcuacaucugcagcggggucuucggcgacaacccgcggcccaacgacgggaccggcuccugcggccccaugagccccaacggggcguacggcgugaagggguucuccuucaaguacggcaacgggguguggaucggccgcaccaagagcaccaacucccggagcggcuucgagaugaucugggacccgaacggguggaccggcaccgacuccagcuucagcgucaagcaggacaucguggccaucaccgacugguccggguacagcggcuccuucgugcagcaccccgagcugacggggcucgacugcauccgccccugcuucugggucgagcugauccggggccgccccaaggagagcaccaucuggaccuccggcagcuccaucagcuucugcggggugaacuccgacaccgucagcugguccuggccggacggcgccgagcugcccuucacgaucgacaaguga

SEQ ID NO: 76617 - RNA, 1350 nt, Artificial Sequence
  derived and/or modified sequence opt1 from neuraminidase__InfluenzaA__ABL07032
augaaccccaaccagaagaucaucaccaucggcagcaucugcauggugaucgggaucgucucccugaugcuccagaucggcaacauggugagcaccugggugucccacagcauccagacggggaaccaguaccaggccgaguccaucagcaacaccaacccgcugaccgagaaggccgucgcguccgugacccuggccggcaacagcucccucugccccauccgcgggugggccgugcacagcaaggacaacaacauccggaucggcuccaagggcgacgucuucgugauccgcgagcccuucaucagcugcucccaccuggagugccggacguucuuccugacccagggggcccuccugaacgacaagcacagcaacggcaccgugaaggaccgcagcccccaccggacccugaugagcugcccggucggggaggcccccucccccuacaacagccgcuucgaguccguggcguggagcgccagcgccugccacgacggcacguccuggcucaccaucgggaucagcggccccgacaacgaggccguggcgguccugaaguacaacggcaucaucaccgacaccaucaaguccuggcggaacaacauccugcgcacgcaggagagcgagugcgccugcgugaacggguccugcuucaccgugaugaccgacggcccgagcaacgggcaggccuccuacaagaucuucaagauggagaagggcaaggucgugaaguccguggagcucgacgcccccaacuaccacuacgaggagugcuccugcuaccccgacgccggcgagaucacgugcgucugccgggacaacuggcacgggagcaaccgccccuggguguccuucaaccagaaccuggaguaccagaucggcuacaucugcagcgggguguucggcgacaacccgcggcccaacgacgggaccggcuccugcggccccaugagccccaacggggcguacggcgucaagggguucuccuucaaguacggcaacgggguguggaucggccgcaccaagagcaccaacucccggagcggcuucgagaugaucugggacccgaacggguggaccggcacggacuccagcuucagcgugaagcaggacaucgucgccaucaccgacugguccggguacagcggcuccuucgugcagcaccccgagcugaccgggcucgacugcauccgccccugcuucugggucgagcugauccggggccgccccaaggagagcaccaucuggacguccggcagcuccaucagcuucugcggggugaacuccgacaccgugagcugguccuggccggacggcgccgagcugcccuucaccaucgacaaguga

SEQ ID NO: 76618 - RNA, 1350 nt, Artificial Sequence
  derived and/or modified sequence opt1 from neuraminidase__InfluenzaA__ABL31746
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaacuccuggcucaccaucgggaucagcggccccgacaacgaggccguggcggugcugaaguacaacggcaucaucacggacaccaucaaguccuggcggaagaacauccugcgcacccaggagagcgagugcgccugcgucaacggguccugcuucaccgugaugacggacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucaccgacugguccggguacagcggcuccuucguccagcaccccgagcugacggggcucgacugcauccgccccugcuucuggguggagcugauccggggccgccccaaggagagcaccaucuggaccuccggcagcuccaucagcuucugcggggucaacuccgacaccgugagcugguccuggccggacggcgccgagcugcccuucacgaucgacaaguga

SEQ ID NO: 76619 - RNA, 1350 nt, Artificial Sequence
  derived and/or modified sequence opt1 from neuraminidase__InfluenzaA__ABL31757
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacgaggccguggcggugcugaaguacaacggcaucaucaccgacaccaucaaguccuggcggaacaacauccugcgcacccaggagagcgagugcgccugcgucaacggguccugcuucacggugaugaccgacggcccgagcaacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucacggacugguccggguacagcggcuccuucguccagcaccccgagcugaccgggcucgacugcauccgccccugcuucuggguggagcugauccggggccgccccaaggagagcaccaucuggaccuccggcagcuccaucagcuucugcggggucaacuccgacacggugagcugguccuggccggacggcgccgagcugcccuucaccaucgacaaguga

SEQ ID NO: 76620 - RNA, 1350 nt, Artificial Sequence; identical to SEQ ID NO: 76619
  derived and/or modified sequence opt1 from neuraminidase__InfluenzaA__ABL31768

SEQ ID NO: 76621 - RNA, 1410 nt, Artificial Sequence; identical to SEQ ID NO: 75599
  derived and/or modified sequence opt1 from neuraminidase__InfluenzaA__ABL67168

SEQ ID NO: 76622 - RNA, 1410 nt, Artificial Sequence; identical to SEQ ID NO: 75738
  derived and/or modified sequence opt1 from neuraminidase__InfluenzaA__ABL67179

SEQ ID NO: 76623 - RNA, 1413 nt, Artificial Sequence; identical to SEQ ID NO: 76564
  derived and/or modified sequence opt1 from neuraminidase__InfluenzaA__ABL67190

SEQ ID NO: 76624 - RNA, 1410 nt, Artificial Sequence
  derived and/or modified sequence opt1 from neuraminidase__InfluenzaA__ABL67201
augaaccccaaccagaagaucaucaccaucagcuccgugagccugaccaucuccacgaucugcuucuucaugcagaucgccauccucaucaccaccgucacccugcacuucaagcaguacgaguucaacagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggcuucgcgcccuucagcaaggacaacuccauccgccugagcgccgggggcgacaucugggucacccgggagcccuacguguccugcgaccccgacaagugcuaccaguucgcccucgggcagggcaccacgcugaacaacgugcacagcaacgacaccguccacgaccgcaccccguaccggacccugcucaugaacgagcugggggugcccuuccaccugggcacgaagcaggucugcaucgccugguccagcuccagcugccacgacggcaaggccuggcuccacgugugcgugaccggggacgacaagaacgcgaccgccuccuucaucuacaacggccgccugguggacagcaucgucuccuggagcaagaagauccugcggacccaggaguccgagugcgugugcaucaacgggacgugcaccguggucaugaccgacggcagcgccagcgggaaggccgacaccaagauccucuucaucgaggagggcaagaucgugcacacguccacccugagcggcuccgcgcagcacguggaggagugcagcugcuacccccgcuaccccgggguccggugcgugugccgcgacaacuggaagggcuccaaccggccgaucguggacaucaacaucaaggacuacagcaucgucuccagcuacgugugcuccgggcuggugggcgacacgccccgcaagaacgacagcuccagcuccagccacugccucgaccccaacaacgaggagggcgggcacggcgucaaggggugggccuucgacgacggcaacgacguguggauggggcggaccaucuccgagaagcugcgcagcggcuacgagaccuucaaggucaucgagggcugguccaaccccaacagcaagcugcagaucaaccgccaggugaucguggaccgggggaaccgguccggcuacagcgggaucuucagcgucgagggcaaguccugcaucaaccgcugcuucuacguggagcucauccgggggcgcaaggaggagaccgaggugcuguggaccagcaacuccaucgucguguucugcggcaccagcggcacguacgggaccggcuccuggccggacggggccgacaucaaccugaugcccaucuga

SEQ ID NO: 76625 - RNA, 1413 nt, Artificial Sequence; identical to SEQ ID NO: 76564
  derived and/or modified sequence opt1 from neuraminidase__InfluenzaA__ABL67212

SEQ ID NO: 76626 - RNA, 1413 nt, Artificial Sequence; identical to SEQ ID NO: 76067
  derived and/or modified sequence opt1 from neuraminidase__InfluenzaA__ABL67256

SEQ ID NO: 76627 - RNA, 1413 nt, Artificial Sequence; identical to SEQ ID NO: 76067
  derived and/or modified sequence opt1 from neuraminidase__InfluenzaA__ABL67267

SEQ ID NO: 76628 - RNA, 1410 nt, Artificial Sequence; identical to SEQ ID NO: 75069
  derived and/or modified sequence opt1 from neuraminidase__InfluenzaA__ABL67278

SEQ ID NO: 76629 - RNA, 1410 nt, Artificial Sequence
  derived and/or modified sequence opt1 from neuraminidase__InfluenzaA__ABL67289
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucuacgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76630 - RNA, 1410 nt, Artificial Sequence
  derived and/or modified sequence opt1 from neuraminidase__InfluenzaA__ABL67300
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaacauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76631 - RNA, 1410 nt, Artificial Sequence; identical to SEQ ID NO: 75188
  derived and/or modified sequence opt1 from neuraminidase__InfluenzaA__ABL67311

SEQ ID NO: 76632 - RNA, 1410 nt, Artificial Sequence
  derived and/or modified sequence opt1 from neuraminidase__InfluenzaA__ABL67322
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggagcuccagcuccugccacgacggcaaggcguggcugcacgucugcgugaccggggacgacgagaacgccaccgccagcuucaucuacaacggccggcugguggacuccaucgggagcugguccaagaagauccuccgcacccaggagagcgagugcgucugcaucaacggcacgugcaccguggugaugaccgacggcuccgccagcgggaaggcggacaccaagauccuguucaucgaggagggcaagaucguccacacguccacccugagcgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacagcaagcuccagaccaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcacgagcgggaccuacggcaccggguccuggcccgacggcgccgacaucaaccugaugcccaucuga

SEQ ID NO: 76633 - RNA, 1410 nt, Artificial Sequence
  derived and/or modified sequence opt1 from neuraminidase__InfluenzaA__ABL67333
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgccugguccagcuccagcugccacgacggcaaggcguggcugcacgucugcgugacgggggacgacgagaacgccaccgccuccuucaucuacaacggcaagcugguggacagcaucggguccuggagcaagaagauccuccggacccaggaguccgagugcgucugcaucaacgggaccugcgccguggugaugacggacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 76634 - RNA, 1410 nt, Artificial Sequence; identical to SEQ ID NO: 75599
  derived and/or modified sequence opt1 from neuraminidase__InfluenzaA__ABL67344

SEQ ID NO: 76635 - RNA, 1410 nt, Artificial Sequence
  derived and/or modified sequence opt1 from neuraminidase__InfluenzaA__ABL67355
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgagaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacaagaacgcgaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcucgucggcgacacgccccgcaagaacgacagcuucuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccgccaggugaucgucgagcggggcaaccggagcggguacuccggcaucuucagcguggagggcaaguccugcaucaaccgcugcuucuacguggagcugauccgggggcgcaaggaggagaccgaggucugguggaccagcaacagcaucgugguguucugcggcaccuccgggaccuacggcacggggagcuggccggacggcgccgacaucaaccugaugcccaucuga

SEQ ID NO: 76636 - RNA, 1410 nt, Artificial Sequence
  derived and/or modified sequence opt1 from neuraminidase__InfluenzaA__ABL67366
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacacccggauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggaccuacggcacggggagcuggccggacggcgccgacaucaaccugaugcccaucuga

SEQ ID NO: 76637 - RNA, 1410 nt, Artificial Sequence
  derived and/or modified sequence opt1 from neuraminidase__InfluenzaA__ABL67377
augaaccccaaccagaagaucaucaccaucggcagcgccucccugaccaucgccaucaucugcuuccucauccagaucgcgauccuggugacgaccgucacccugcacuucaagcagcacgagugcaacagcccgcccaacaaccaggugaugcucugcgagcccaccaucaucgagcgcaacaucacggagaucguguaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggucacccgggagcccuacguguccugcgaccccgacaagugcuaccaguucgcccugggccaggggaccacccugaacaacggccacagcaacgacacggugcacgaccgcaccccguaccggacccuccugaugaacgagcugggcguccccuuccaccucgggacccgccaggugugcaucgcgugguccagcuccagcugccacgacggcaaggccuggcugcacgugugcgucacgggggacgacaagaacgccaccgccuccuucaucuacaacggccggcugguggacagcaucuccagcugguccaagaagauccuccgcacccaggagagcgagugcgugugcaucaacgggaccugcacggucgugaugaccgacggcuccgcgagcggcaaggccgacaccaagauccuguucaucgaggaggggaagaucauccacaucagcacccuguccggcagcgcccagcacguggaggagugcuccugcuacccccgguaccccgggguccgcugcgugugccgggacaacuggaagggcagcaaccgcccgaucguggacaucaacgucaaggacuacuccaucgugagcuccuacgugugcagcggccucgucggggacacgccccggaagaacgacuccuucagcuccagccacugccuggaccccaacaacgaggagggcgggcacggcgugaaggggugggccuucgacgacggcaacgacguguggaugggccgcaccaucuccgagaagcugcggagcggguacgagaccuucaaggucaucgagggcugguccaaccccaacagcaagcuccagaucaaccgccaggugaucgucgagcgggggaaccgcuccggcuacagcgggaucuucuccguggagggcaagagcugcaucaaccggugcuucuacguggagcugauccgcggccggaaggaggagaccgaggucugguggacgagcaacuccaucgugguguucugcgggaccagcggcaccuacgggaccggcuccuggccggacggggccgaccugaaccucaugcccaucuga

SEQ ID NO: 76638 - RNA, 1410 nt, Artificial Sequence; identical to SEQ ID NO: 75335
  derived and/or modified sequence opt1 from neuraminidase__InfluenzaA__ABL67388

SEQ ID NO: 76639 - RNA, 1410 nt, Artificial Sequence; identical to SEQ ID NO: 75335
  derived and/or modified sequence opt1 from neuraminidase__InfluenzaA__ABL67399

SEQ ID NO: 76640 - RNA, 1410 nt, Artificial Sequence; identical to SEQ ID NO: 75720
  derived and/or modified sequence opt1 from neuraminidase__InfluenzaA__ABL67410

SEQ ID NO: 76641 - RNA, 1410 nt, Artificial Sequence
  derived and/or modified sequence opt1 from neuraminidase__InfluenzaA__ABL67421
augaaccccaaccagaagaucaucaccaucggcagcaucucccugaccaucagcacgaucugcuucuucaugcagaucgccauccucaucaccaccgugacccugcacuucaagcaguacgaguucaacuccccgcccaacaaccaggucaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgugagcugguccaaggagauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 76642 - RNA, 1350 nt, Artificial Sequence
  derived and/or modified sequence opt1 from neuraminidase__InfluenzaA__ABL67772
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacaacggcgccguggcggugcugaaguacaacgggaucaucaccgacaccaucaaguccuggcgcaacaacauccuccggacccaggagagcgagugcgccugcgucaacggcuccugcuucacggugaugaccgacgggccgagcaacggccaggccucccacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccugaaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcucaccgggcuggacugcauccggcccugcuucugggucgagcugauccgcggccggcccaaggaguccaccaucuggaccagcggcuccagcaucuccuucugcggggugaacagcgacacggugggcugguccuggcccgacggggccgagcucccguucaccaucgacaaguga

SEQ ID NO: 76643 - RNA, 1350 nt, Artificial Sequence
  derived and/or modified sequence opt1 from neuraminidase__InfluenzaA__ABL67783
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacuccggcgccguggcggugcugaaguacaacgggaucaucaccgacaccaucaagagcuggcgcaacaacauccuccggacccaggaguccgagugcgccugcgucaacggcagcugcuucacggugaugaccgacgggccguccaacggccaggccagccacaagaucuucaagauggagaagggcaagguggucaaguccguggagcuggacgcccccaacuaccacuacgaggagugcagcugcuaccccgacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccguguccagcaacggcgcguacggggucaagggcuucuccuucaaguacgggaacggcguguggaucggccggaccaagagcaccaacucccgcagcggguucgagaugaucugggaccccaacggcuggaccgagaccgacagcuccuucagcgugaagcaggacaucgucgccaucacggacugguccggguacagcggcuccuucgugcagcacccggagcucaccgggcuggacugcauccggcccugcuucugggucgagcugauccgcggccggcccaaggagagcaccaucuggaccuccggcagcuccaucagcuucugcggggugaacuccgacacggugggcuggagcuggcccgacggggccgagcucccguucaccaucgacaaguga

SEQ ID NO: 76644 - RNA, 1350 nt, Artificial Sequence
  derived and/or modified sequence opt1 from neuraminidase__InfluenzaA__ABL67796
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacaacggcgccguggcggugcugaaguacaacgggaucaucaccgacaccaucaaguccuggcgcaacaacauccuccggacccaggagagcgagugcgccugcgucaacggcuccugcuucacggugaugaccgacgggccgagcaacggccaggccucccacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuacaacggcgcguacggggucaagggcuucuccuucaaguacgggaacggcguguggaucggccggaccaagagcaccaacucccgcagcggguucgagaugaucugggaccccaacggcuggaccgagaccgacuccagcuucagcgugaagcaggacaucgucgccaucacggacugguccggguacagcggcuccuucgugcagcacccggagcucaccgggcuggacugcauccggcccugcuucugggucgagcugauccgcggccggcccaaggagagcaccaucuggaccuccggcagcuccaucagcuucugcggggugaacuccgacacggugggcuggagcuggcccgacggggccgagcucccguucaccaucgacaaguga

SEQ ID NO: 76645 - RNA, 1350 nt, Artificial Sequence
  derived and/or modified sequence opt1 from neuraminidase__InfluenzaA__ABL67807
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaaccugcucaccgagaaggccguggcgagcgucaagcuggccggcaacuccagccugugccccaucgacgggugggccguguacuccaaggacaacagcauccgcaucggcuccaagggcgacguguucgucgugcgggagcccuucaucagcugcucccaccucgagugccgcaccuucuuccugacgcagggggcccugcucaacgacaagcacagcaacggcaccgugaaggaccggagcccccaccgcacccugaugagcugcccggucggggaggcccccucccccuacaacagccgguucgaguccguggcguggagcgccagcgccugccacgacggcaccuccuggcugacgaucgggaucagcggccccgacaacggcgccguggcgguccucaaguacaacgggaucaucaccgacaccaucaaguccuggcgcaacaacauccugcggacccaggagagcgagugcgccugcgugaacggcuccugcuucacggugaugaccgacgggccgagcaacggccaggccucccacaagaucuucaagauggagaagggcaaggucgugaaguccguggagcuggacgcccccaacuaccacuacgaggagugcuccugcuaccccgacgccggggagaucacgugcgucugccgcgacaacuggcacggcagcaaccggcccuggguguccuucaaccagaaccucgaguaccagaucggguacaucugcagcggcguguucggggacaacccgcgccccaacgacggcgcgggcuccugcgggcccgucagcuccaacggcgccuacggggugaagggcuucagcuucaaguacgggaacggcguguggaucggccggaccaaguccaccaacagccgcuccggguucgagaugaucugggaccccaacggcuggaccgagaccgacagcagcuucuccgucaagcaggacaucguggccaucaccgacuggagcggguacuccggcagcuucguccagcacccggagcugacggggcuggacugcauccggcccugcuucuggguggagcucauccgcggccggcccaaggaguccaccaucuggaccagcggcuccagcaucuccuucugcggggugaacagcgacaccgucggcugguccuggcccgacggggccgagcugccguucacgaucgacaaguga

SEQ ID NO: 76646 - RNA, 1350 nt, Artificial Sequence
  derived and/or modified sequence opt1 from neuraminidase__InfluenzaA__ABL67818
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaaccugcucaccgagaaggccguggcgagcgucaagcuggccggcaacuccagccugugccccaucgacgggugggccguguacuccaaggacaacagcauccgcaucggcuccaagggcgacguguucgucgugcgggagcccuucaucagcugcucccaccucgagugccgcaccuucuuccugacgcagggggcccugcucaacgacaagcacagcaacggcaccgugaaggaccggagcccccaccgcacccugauguccugcccggucggggaggcccccucccccuacaacagccgguucgaguccguggcguggagcgccagcgccugccacgacggcaccuccuggcugacgaucgggaucagcggccccgacaacggcgccguggcgguccucaaguacaacgggaucaucaccgacaccaucaaguccuggcgcaacaacauccugcggacccaggagagcgagugcgccugcgugaacggcuacugcuucacggugaugaccgacgggccguccaacggccaggccagccacaagaucuucaagauggagaagggcaaggucgugaaguccguggagcuggacgcccccaacuaccacuacgaggagugcagcugcuaccccgacgccggggagaucacgugcgucugccgcgacaacuggcacggcuccaaccggcccugggugagcuucaaccagaaccucgaguaccagaucggguacaucugcuccggcguguucggggacaacccgcgccccaacgacggcgcgggcagcugcgggcccgucuccagcaacggcgccuacggggugaagggcuucuccuucaaguacgggaacggcguguggaucggccggaccaagagcaccaacucccgcagcggguucgagaugaucugggaccccaacggcuggaccgagaccgacuccagcuucagcgucaagcaggacaucguggccaucaccgacugguccggguacagcggcuccuucguccagcacccggagcugacggggcuggacugcauccggcccugcuucuggguggagcucauccgcggccggcccaaggagagcaccaucuggaccuccggcagcuccaucagcuucugcggggugaacuccgacaccgucggcuggagcuggcccgacggggccgagcugccguucacgaucgacaaguga

SEQ ID NO: 76647 - RNA, 1350 nt, Artificial Sequence
  derived and/or modified sequence opt1 from neuraminidase__InfluenzaA__ABL67829
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaaccugcucaccgagaaggccguggcgagcgucaagcuggccggcaacuccagccugugccccaucaacgggugggccguguacuccaaggacaacagcauccgcaucggcuccaagggcgacguguucgucgugcgggagcccuucaucagcugcucccaccucgagugccgcaccuucuuccugacgcagggggcccugcucaacgacaagcacagcaacggcaccgugaaggaccggagcccccaccgcacccugauguccugcccggucggggaggcccccucccccuacaacagccgguucgaguccguggcguggagcgccagcgccugccacgacggcaccuccuggcugacgaucgggaucagcggccccgacaacggcgccguggcgguccucaaguacaacgggaucaucaccgacaccaucaaguccuggcgcaacaacauccugcggacccaggagagcgagugcgccugcgugaacggcuucugcuucacggugaugaccgacgggccguccaacggccaggccagccacaagaucuucaagauggagaagggcaaggucgugaaguccguggagcuggacgcccccaacuaccacuacgaggagugcagcugcuaccccgacgccggggagaucacgugcgucugccgcgacaacuggcacggcuccaaccggcccugggugagcuucaaccagaaccucgaguaccagaucggguacaucugcuccggcguguucggggacaacccgcgccccaacgacggcgcgggcagcugcgggcccgucgccuccaacggcgccuacggggugaagggcuucagcuucaaguacgggaacggcguguggaucggccggaccaaguccaccaacagccgcuccggguucgagaugaucugggaccccaacggcuggaccgagaccgacagcuccuucagcgucaagcaggacaucguggccaucaccgacuggagcggguacuccggcagcuucguccagcacccggagcugacggggcuggacugcauccggcccugcuucuggguggagcucauccgcggccggcccaaggaguccaccaucuggaccagcggcuccagcaucuccuucugcggggugaacagcgacaccgucggcugguccuggcccgacggggccgagcugccguucacgaucgacaaguga

SEQ ID NO: 76648 - RNA, 1410 nt, Artificial Sequence; identical to SEQ ID NO: 75720
  derived and/or modified sequence opt1 from neuraminidase__InfluenzaA__ABM22018

SEQ ID NO: 76649 - RNA, 1413 nt, Artificial Sequence; identical to SEQ ID NO: 76564
  derived and/or modified sequence opt1 from neuraminidase__InfluenzaA__ABM22029

SEQ ID NO: 76650 - RNA, 1410 nt, Artificial Sequence; identical to SEQ ID NO: 75722
  derived and/or modified sequence opt1 from neuraminidase__InfluenzaA__ABM22040

SEQ ID NO: 76651 - RNA, 1410 nt, Artificial Sequence; identical to SEQ ID NO: 76629
  derived and/or modified sequence opt1 from neuraminidase__InfluenzaA__ABM22062

SEQ ID NO: 76652 - RNA, 1410 nt, Artificial Sequence
  derived and/or modified sequence opt1 from neuraminidase__InfluenzaA__ABM22073
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuucaaccucgggacgcgccaggugugcaucgccugguccagcuccagcugccacgacggcaaggcguggcugcacgucugcgugaccggggacgacgagaacgccaccgccuccuucaucuacaacggcaagcugguggacagcaucggguccuggagcaagaagauccuccggacccaggaguccgagugcgucugcaucaacggcacgugcgccguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagacggaggugugguggaccagcaacagcaucgucguguucugcggcaccuccgggaccuacggcacggggagcuggccggacggcgccgacaucaaccugaugcccaucuga

SEQ ID NO: 76653 - RNA, 1410 nt, Artificial Sequence; identical to SEQ ID NO: 75599
  derived and/or modified sequence opt1 from neuraminidase__InfluenzaA__ABM22084

SEQ ID NO: 76654 - RNA, 1410 nt, Artificial Sequence
  derived and/or modified sequence opt1 from neuraminidase__InfluenzaA__ABM22095
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggcgaugcucugcgagcccacgaucaucgagcgcaacaucaccgagaucgugcaccugaccaacaccacgaucgagaaggagaucugccccaagcuggucgaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76655 - RNA, 1410 nt, Artificial Sequence; identical to SEQ ID NO: 75599
  derived and/or modified sequence opt1 from neuraminidase__InfluenzaA__ABM22106

SEQ ID NO: 76656 - RNA, 1410 nt, Artificial Sequence; identical to SEQ ID NO: 75599
  derived and/or modified sequence opt1 from neuraminidase__InfluenzaA__ABM22117

SEQ ID NO: 76657 - RNA, 1410 nt, Artificial Sequence; identical to SEQ ID NO: 76610
  derived and/or modified sequence opt1 from neuraminidase__InfluenzaA__ABM22128

SEQ ID NO: 76658 - RNA, 1410 nt, Artificial Sequence
  derived and/or modified sequence opt1 from neuraminidase__InfluenzaA__ABM22139
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcgagaaggccgacaccaagauccucuucaucgaggagggcaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcgggcuggugggcgacacgccccgcaagaacgacuccagcuccagcucccacugccucgaccccaacaacgaggagggcgggcacggcgucaaggggugggccuucgacgacggcaacgacguguggauggggcggaccaucagcgagaagcugcgcuccggcuacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 76659 - RNA, 1410 nt, Artificial Sequence
  derived and/or modified sequence opt1 from neuraminidase__InfluenzaA__ABM22150
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccgagcuggccgaguaccggaacuggagcaagccccagugcgacaucaccggguucgcgccguucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcacccccuaccggacccuccugaugaacgagcugggcgugccguuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaagaagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcagcggccucgugggcgacaccccgcgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggcccgacggcgccgacaucaaccucaugccgaucuga

SEQ ID NO: 76660 - RNA, 1413 nt, Artificial Sequence; identical to SEQ ID NO: 76067
  derived and/or modified sequence opt1 from neuraminidase__InfluenzaA__ABM22161

SEQ ID NO: 76661 - RNA, 1413 nt, Artificial Sequence; identical to SEQ ID NO: 76067
  derived and/or modified sequence opt1 from neuraminidase__InfluenzaA__ABM22172

SEQ ID NO: 76662 - RNA, 1413 nt, Artificial Sequence; identical to SEQ ID NO: 76067
  derived and/or modified sequence opt1 from neuraminidase__InfluenzaA__ABM22183

SEQ ID NO: 76663 - RNA, 1413 nt, Artificial Sequence; identical to SEQ ID NO: 76067
  derived and/or modified sequence opt1 from neuraminidase__InfluenzaA__ABM22194

SEQ ID NO: 76664 - RNA, 1413 nt, Artificial Sequence; identical to SEQ ID NO: 76067
  derived and/or modified sequence opt1 from neuraminidase__InfluenzaA__ABM22205

SEQ ID NO: 76665 - RNA, 1413 nt, Artificial Sequence; identical to SEQ ID NO: 76067
  derived and/or modified sequence opt1 from neuraminidase__InfluenzaA__ABM22216

SEQ ID NO: 76666 - RNA, 1413 nt, Artificial Sequence; identical to SEQ ID NO: 76067
  derived and/or modified sequence opt1 from neuraminidase__InfluenzaA__ABM22227

SEQ ID NO: 76667 - RNA, 1413 nt, Artificial Sequence; identical to SEQ ID NO: 76067
  derived and/or modified sequence opt1 from neuraminidase__InfluenzaA__ABM22238

SEQ ID NO: 76668 - RNA, 1413 nt, Artificial Sequence
  derived and/or modified sequence opt1 from neuraminidase__InfluenzaA__ABM22271
augaaccccaaccagaagaucaucaccaucggcagcaucuccaucgugaucgggaucaucagccugauccuccagaucggcaacaucaucuccaucugggccagccacuccauccagaccgggagccagaaccacacgggcaucugcaaccagcgcaucaucaccuacgagaacuccaccugggucaaccagaccuacgugaacaucaacaacacgaacguggucgccgggaaggacaagaccagcaugacccuggcgggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggccccgagccccuacaacucccgguucgagagcguggcguggagcgccuccgccugccacgacggccucggcuggcugaccaucgggaucagcggccccgacaacggggccguggcgguccugaaguacaacggcaucaucacggagaccaucaaguccuggaagaagcgcauccuccggacccaggagagcgagugcgugugcaugaacggcuccugcuucaccaucaugacggacgggcccagcaacggcgccgccuccuaccgcaucuucaagaucgagaaggggcgggugaccaagagcaucgagcugggcgccccgaacuaccacuacgaggagugcuccugcuaccccgacaccgggaccgucaugugcgugugccgcgacaacuggcacggcagcaaccggcccuggguguccuucaaccagaaccuggacuaccagaucggcuacaucugcagcggggucuucggcgacaacccccgcccgaaggacggggagggcuccugcaaccccgugacgguggacggggccgacggcgucaagggcuucagcuaccgguacgggaacggcguguggaucgggcgcaccaaguccaaccggcuccgcaagggcuucgagaugaucugggaccccaacggguggaccgacaccgacagcgacuucuccaugaagcaggacaucguggcgaugacggacuggagcggcuacuccggcagcuucguccagcaccccgagcugaccgggcuggacugcaugcggccgugcuucuggguggagcucgugcgcggccugccccgggagaacaccaccaucuggacgagcggguccagcaucuccuucugcggcgucaacagcgacaccgccaacugguccuggcccgacggcgccgagcugcccuucaccaucgacaaguga

SEQ ID NO: 76669 - RNA, 1413 nt, Artificial Sequence; identical to SEQ ID NO: 75976
  derived and/or modified sequence opt1 from neuraminidase__InfluenzaA__ABM22282

SEQ ID NO: 76670 - RNA, 1410 nt, Artificial Sequence; identical to SEQ ID NO: 75351
  derived and/or modified sequence opt1 from neuraminidase__InfluenzaA__ABM22304

SEQ ID NO: 76671 - RNA, 1410 nt, Artificial Sequence; identical to SEQ ID NO: 75351
  derived and/or modified sequence opt1 from neuraminidase__InfluenzaA__ABM22315

SEQ ID NO: 76672 - RNA, 1410 nt, Artificial Sequence; identical to SEQ ID NO: 75351
  derived and/or modified sequence opt1 from neuraminidase__InfluenzaA__ABM22326

SEQ ID NO: 76673 - RNA, 1410 nt, Artificial Sequence; identical to SEQ ID NO: 75351
  derived and/or modified sequence opt1 from neuraminidase__InfluenzaA__ABM22337

SEQ ID NO: 76674 - RNA, 1410 nt, Artificial Sequence; identical to SEQ ID NO: 75354
  derived and/or modified sequence opt1 from neuraminidase__InfluenzaA__ABM22348

SEQ ID NO: 76675 - RNA, 1410 nt, Artificial Sequence; identical to SEQ ID NO: 75354
  derived and/or modified sequence opt1 from neuraminidase__InfluenzaA__ABM22359

SEQ ID NO: 76676 - RNA, 1410 nt, Artificial Sequence; identical to SEQ ID NO: 75354
  derived and/or modified sequence opt1 from neuraminidase__InfluenzaA__ABM22370

SEQ ID NO: 76677 - RNA, 1413 nt, Artificial Sequence; identical to SEQ ID NO: 75933
  derived and/or modified sequence opt1 from neuraminidase__InfluenzaA__ABM66867

SEQ ID NO: 76678 - RNA, 1413 nt, Artificial Sequence; identical to SEQ ID NO: 76067
  derived and/or modified sequence opt1 from neuraminidase__InfluenzaA__ABM66900

SEQ ID NO: 76679 - RNA, 1413 nt, Artificial Sequence; identical to SEQ ID NO: 76067
  derived and/or modified sequence opt1 from neuraminidase__InfluenzaA__ABM66911

SEQ ID NO: 76680 - RNA, 1410 nt, Artificial Sequence; identical to SEQ ID NO: 75354
  derived and/or modified sequence opt1 from neuraminidase__InfluenzaA__ABM66922

SEQ ID NO: 76681 - RNA, 1410 nt, Artificial Sequence; identical to SEQ ID NO: 75354
  derived and/or modified sequence opt1 from neuraminidase__InfluenzaA__ABM66933

SEQ ID NO: 76682 - RNA, 1410 nt, Artificial Sequence; identical to SEQ ID NO: 75354
  derived and/or modified sequence opt1 from neuraminidase__InfluenzaA__ABM66944

SEQ ID NO: 76683 - RNA, 1410 nt, Artificial Sequence; identical to SEQ ID NO: 75354
  derived and/or modified sequence opt1 from neuraminidase__InfluenzaA__ABM66955

SEQ ID NO: 76684 - RNA, 1410 nt, Artificial Sequence; identical to SEQ ID NO: 75354
  derived and/or modified sequence opt1 from neuraminidase__InfluenzaA__ABM66966

SEQ ID NO: 76685 - RNA, 1410 nt, Artificial Sequence; identical to SEQ ID NO: 75354
  derived and/or modified sequence opt1 from neuraminidase__InfluenzaA__ABM66977

SEQ ID NO: 76686 - RNA, 1410 nt, Artificial Sequence; identical to SEQ ID NO: 75354
  derived and/or modified sequence opt1 from neuraminidase__InfluenzaA__ABM66988

SEQ ID NO: 76687 - RNA, 1410 nt, Artificial Sequence; identical to SEQ ID NO: 75354
  derived and/or modified sequence opt1 from neuraminidase__InfluenzaA__ABM66999

SEQ ID NO: 76688 - RNA, 1410 nt, Artificial Sequence; identical to SEQ ID NO: 75354
  derived and/or modified sequence opt1 from neuraminidase__InfluenzaA__ABM67010

SEQ ID NO: 76689 - RNA, 1410 nt, Artificial Sequence; identical to SEQ ID NO: 75354
  derived and/or modified sequence opt1 from neuraminidase__InfluenzaA__ABM67021

SEQ ID NO: 76690 - RNA, 1413 nt, Artificial Sequence
  derived and/or modified sequence opt1 from neuraminidase__InfluenzaA__ABM67054
augaaccccaaccagaagaucaucaccaucggcagcaucuccaucgccaucgggaccaucagccugaugcuccagaucggcaacaugaucuccaucugggccagccacuccauccagacggggagccagaaccacaccggcaucugcaaccagcgcaucaucaccuacgagaacuccaccugggugaaccacacguacgucaacaucaacaacaccaacgugguggcggggaaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggagcggguacagcggcuccuucguccagcaccccgagcucaccggccuggacugcauccgccccugcuucuggguggagcugguccgggggcucccgcgcgagaacaccacgaucuggaccagcggcuccagcaucuccuucugcgggguggacagcgacaccgccaacugguccuggcccgacggcgccgagcugcccuucaccaucgacaaguga

SEQ ID NO: 76691 - RNA, 1350 nt, Artificial Sequence
  derived and/or modified sequence opt1 from neuraminidase__InfluenzaA__ABM68048
augaaccccaaccagaagaucaucaccaucggcagcaucugcauggugaucgggaucgucucccugaugcuccagaucggcaacaucaucagcaucuggaucucccacagcauccagaccgggaaccagugccaggccggcccgaucuccaacacgaaguuccugaccgagaaggccguggcgagcgugacccuggccgggaacuccagccucugccccaucuccggcugggccgucuacagcaaggacaacuccauccgcaucggcagccgcggggacguguucgugauccgggaguccuucaucagcugcucccaccuggagugccggaccuucuuccugacgcagggcgcccuccugaacgacaagcacagcaacgggaccgucaaggaccgcagcccccaccggacccugaugagcugccccgugggcgaggccccgucccccuacaacagccgcuucgagagcguggcgugguccgccagcgccugccacgacgggaccuccuggcucacgaucggcaucagcggccccgacaacggggccgucgcggugcugaaguacaacggcaucaucaccgacaccaucaaguccuggcggaacaacauccugcgcacccaggagagcgagugcgccugcgugaacggguccugcuucacggucaugaccgacggccccagcaacggccaggccuccuacaagaucuucaagauggagaaggggaagguggugaaguccgucgagcucgacgccccgaacuaccacuacgaggagugcuccugcuaccccgacgccggcgagaucacgugcgugugccgggacagcuggcacggguccaaccgccccugggugagcuucaaccagaaccuggaguaccagaucggcuacaucugcuccggggucuucggcgacaacccccggccgaacgacggcaccgggagcugcggccccgugucccccaacggggcguacggcgugaagggguucagcuucaaguacggcaacggcgucuggaucgggcgcaccaaguccaccaacagccggagcggcuucgagaugaucugggaccccaacggguggaccggcaccgacuccagcuucuccgugaagcaggacaucguggccaucacggacuggagcggguacuccggcagcuucguccagcacccggagcugaccggccucgacugcauccgccccugcuucuggguggagcugauccgggggcgccccaaggaguccaccaucuggaccagcggcuccagcaucuccuucugcggggucaacagcgacacgguguccuggagcuggcccgacggcgccgagcugccguucaccaucgacaaguga

SEQ ID NO: 76692 - RNA, 1350 nt, Artificial Sequence
  derived and/or modified sequence opt1 from neuraminidase__InfluenzaA__ABM68049
augaaccccaaccagaagaucaucaccaucggcagcaucugcauggugaucgggaucgucucccugaugcuccagaucggcaacaucaucagcaucuggaucucccacagcauccagaccgggaaccagugccaggccgagccgaucuccaacacgaaguuccugaccgagaaggccguggcgagcgugacccuggccggcaacuccagccucugccccaucuccgggugggccgucuacagcaaggacaacuccauccgcaucggcagccggggcgacguguucgugauccgcgagcccuucaucuccugcagccaccuggagugccggaccuucuuccugacgcagggggcccuccugaacgacaagcacuccaacggcaccgucaaggaccgcagcccccaccggacccugauguccugcccggugggggaggcccccagccccuacaacucccgcuucgagagcguggcguggagcgccuccgccugccacgacggcaccagcuggcucacgaucgggaucuccggccccgacaacggcgccgucgcggugcugaaguacaacgggaucaucaccgacaccaucaagagcuggcggaacaacauccugcgcacccaggaguccgagugcgccugcgugaacggcagcugcuucacggucaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacagcuggcacggcuccaaccgccccugggugagcuucaaccagaaccuggaguaccagaucggguacaucugcuccggcgucuucggggacaacccgcggcccaacgacggcaccggcagcugcgggcccgugucccccaacggcgcguacggggugaagggcuucagcuucaaguacgggaacggcgucuggaucggccgcaccaaguccaccaacagccggagcggguucgagaugaucugggacccgaacggcuggaccgggaccgacuccagcuucuccgugaagcaggacaucguggccaucacggacuggagcggcuacuccgggagcuucguccagcaccccgagcugaccggccucgacugcauccgccccugcuucuggguggagcugauccggggccgccccaaggaguccaccaucuggaccagcggguccagcaucuccuucugcggcgucaacagcgacacgguguccuggagcuggccggacggggccgagcugcccuucaccaucgacaaguga

SEQ ID NO: 76693 - RNA, 1350 nt, Artificial Sequence
  derived and/or modified sequence opt1 from neuraminidase__InfluenzaA__ABM90436
augaaccccaaccagaagaucaucaccaucggcagcaucugcauggugaucgggaucgucucccugaugcuccagaucggcaacaugaucagcaucugggugucccacagcauccagaaggggaaccagcaccaggccgaguccaucagcaacaccaacccgcugacggagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacccagggggcccuccugaacgacaagcacagcaacggcacggugaaggaccgcagcccccaccggacccugauguccugcccggugggggaggcccccucccccuacaacagccgcuucgaguccgucgcguggagcgccagcgccugccacgacggcaccuccuggcucaccaucgggaucagcggccccgacaacgaggccguggcggugcugaaguacaacggcaucaucacggacaccaucaaguccuggcggaacaacauccugcgcacccaggagagcgagugcgccugcgucaacggguccugcuucaccgugaugacggacggcccgagcaacgggcaggccuccuacaagaucuucaagaugaagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucaccgacugguccggguacagcggcuccuucguccagcaccccgagcugacggggcucgacugcauccgccccugcuucuggguggagcugauccggggccgccccaaggagagcaccaucuggaccuccggcagcuccaucagcuucugcggggucaacuccgacaccgugagcugguccuggccggacggcgccgagcugcccuucacgaucgacaaguga

SEQ ID NO: 76694 - RNA, 1350 nt, Artificial Sequence; identical to SEQ ID NO: 76693
  derived and/or modified sequence opt1 from neuraminidase__InfluenzaA__ABM90447

SEQ ID NO: 76695 - RNA, 1350 nt, Artificial Sequence; identical to SEQ ID NO: 76693
  derived and/or modified sequence opt1 from neuraminidase__InfluenzaA__ABM90458

SEQ ID NO: 76696 - RNA, 1350 nt, Artificial Sequence; identical to SEQ ID NO: 76693
  derived and/or modified sequence opt1 from neuraminidase__InfluenzaA__ABM90469

SEQ ID NO: 76697 - RNA, 1350 nt, Artificial Sequence
  derived and/or modified sequence opt1 from neuraminidase__InfluenzaA__ABM90491
augaaccccaaccagaagaucaucaccaucggcagcaucugcauggugaucgggaucgucucccugaugcuccagaucggcaacaugaucagcaucugggugucccacagcauccagaaggggaaccagcaccaggccgaguccaucagcaacaccaacccgcugacggagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacccagggggcccuccugaacgacaagcacagcaacggcacggugaaggaccgcagcccccaccggacccugauguccugcccggugggggaggcccccucccccuacaacagccgcuucgaguccgucgcguggagcgccagcgccugccacgacggcaccuccuggcucaccaucgggaucagcggccccgacaacgaggccguggcggugcugaaguacaacggcaucaucacggacaccaucaaguccuggcggaacaacauccugcgcacccaggagagcgagugcgccugcgucaacggguccugcuucaccgugaugacggacggcccgagcaacgggcaggccuccuacaagaucuucaagaugaagaagggcaaggugaucaagagcgucgagcucgacgccaccaacuaccacuacgaggagugcuccugcuaccccgacgccggcgagaucacgugcgugugccgggacaacuggcacgggagcaaccgccccuggguguccuucaaccagaaccuggaguaccagaucggcuacaucugcagcggggucuucggcgacaacccccggccgaacgacgggaccggcuccugcggccccaugagccccaacggggcguacggcgugaagggguucuccuucaaguacggcaacgggguguggaucggccgcaccaagagcaccaacucccggagcggcuucgagaugaucugggaccccaacggguggaccggcaccgacuccagcuucagcgucaagcaggacaucguggccaucacggacugguccggguacagcggcuccuucgugcagcacccggagcugaccgggcucgacugcauccgccccugcuucugggucgagcugauccggggccgccccaaggagagcaccaucuggaccuccggcagcuccaucagcuucugcggggugaacuccgacacggucagcugguccuggcccgacggcgccgagcugccguucaccaucgacaaguga

SEQ ID NO: 76698 - RNA, 1350 nt, Artificial Sequence; identical to SEQ ID NO: 76697
  derived and/or modified sequence opt1 from neuraminidase__InfluenzaA__ABM90502

SEQ ID NO: 76699 - RNA, 1350 nt, Artificial Sequence
  derived and/or modified sequence opt1 from neuraminidase__InfluenzaA__ABM90524
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggucuccgugacccuggcgggcaacagcucccucugccccauccgcgggugggccgugcacagcaaggacaacaacauccggaucggcuccaagggcgacgucuucgugauccgcgagcccuucaucagcugcucccaccuggagugccggaccuucuuccugacgcagggggcccuccugaacgacaagcacagcaacggcaccgugaaggaccgcagcccccaccggacccugaugagcugcccggucggggaggcccccucccccuacaacagccgcuucgaguccguggccuggagcgcgagcgccugccacgacggcaccuccuggcucacgaucgggaucagcggccccgacaacgaggccguggccguccugaaguacaacggcaucaucaccgacaccaucaaguccuggcggaacaacauccugcgcacccaggagagcgagugcgcgugcgugaacggguccugcuucacggugaugaccgacggcccgagcaacgggcaggccuccuacaagaucuucaagauggagaagggcaaggucgugaaguccguggagcucgacgcccccaacuaccacuacgaggagugcuccugcuaccccgacgccggcgagaucacgugcgucugccgggacaacuggcacgggagcaaccgccccuggguguccuucaaccagaaccuggaguaccagaucggcuacaucugcagcgggguguucggcgacaacccgcggcccaacgacgggaccggcuccugcggccccaugagccccaacggggccuacggcgucaagggguucuccuucaaguacggcaacgggguguggaucggccgcaccaagagcaccaacucccggagcggcuucgagaugaucugggacccgaacggguggaccggcaccgacuccagcuucagcgugaagcaggacaucgucgcgaucacggacugguccggguacagcggcuccuucgugcagcaccccgagcugaccgggcucgacugcauccgccccugcuucugggucgagcugauccggggccgccccaaggagagcaccaucuggaccuccggcagcuccaucagcuucugcggggugaacuccgacacggugagcugguccuggccggacggcgccgagcugcccuucaccaucgacaaguga

SEQ ID NO: 76700 - RNA, 1350 nt, Artificial Sequence; identical to SEQ ID NO: 76699
  derived and/or modified sequence opt1 from neuraminidase__InfluenzaA__ABM90535

SEQ ID NO: 76701 - RNA, 1350 nt, Artificial Sequence; identical to SEQ ID NO: 76699
  derived and/or modified sequence opt1 from neuraminidase__InfluenzaA__ABM90546

SEQ ID NO: 76702 - RNA, 1413 nt, Artificial Sequence
  derived and/or modified sequence opt1 from neuraminidase__InfluenzaA__ABN50759
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcagcugcuucaccaucaugacggacgggcccuccgacggccaggccagcuaccgcaucuucaagaucgagaaggggaagaucaccaaguccaucgagcuggacgccccgaacagccacuacgaggagugcuccugcuaccccgacaccggcaccgucaugugcgugugccgggacaacuggcacgggagcaaccgccccuggguguccuucaaccagaaccucgacuaccagaucggcuacaucugcagcggcgucuucggggacaacccccggccgaaggacggcaagggguccugcgaccccgugaacguggacggcgccgacggggucaagggcuucagcuaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggagcggguacuccggcagcuucgugcagcaccccgagcugacgggccucgacugcauccggccgugcuucugggucgagcugauccgcgggcggccccgcgagaagaccaccaucuggaccuccggcagcuccaucagcuucugcggggugaacuccgacacggucaacuggagcuggcccgacggcgcggagcugcccuucaccaucgacaaguga

SEQ ID NO: 76703 - RNA, 1410 nt, Artificial Sequence
  derived and/or modified sequence opt1 from neuraminidase__InfluenzaA__ABN50770
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaagaagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 76704 - RNA, 1413 nt, Artificial Sequence
  derived and/or modified sequence opt1 from neuraminidase__InfluenzaA__ABN50903
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacagcucccugugcccggugcggggcugggccaucuacagcaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcgucgcguggagcgccuccgccugccacgacggcaugggcuggcugaccaucgggaucagcggccccgacgacggggccguggcggugcucaaguacaacggcaucaucacggagaccaucaaguccuggcgcaagcggauccugcgcacccaggagagcgagugcgucugcgugaacggcuccugcuucaccaucaugacggacgggcccagcaacggcccggccuccuaccggaucuucaagaucgagaaggggaagaucaccaagagcaucgagcuggacgcccccaacucccacuacgaggagugcagcugcuaccccgacaccggcaccgugaugugcgucugccgcgacaacuggcacggguccaaccggcccugggugagcuucaaccagaaccucgacuaccagaucggcuacaucugcuccggcguguucggggacaacccgcgccccaaggacggcaaggggagcugcggccccgucacgguggacggggccgacggcgugaagggcuucuccuaccgguacgggaacggcgucuggaucgggcgcaccaagagcaacuccagccggaagggcuucgagaugaucugggaccccaacggguggaccgacaccgacuccaacuuccuggugaagcaggacguggucgccaugacggacuggagcggcuacagcggcuccuucauccagcacccggagcugaccgggcucgacugcaugcgccccugcuucuggguggagcugauccggggccgcccccgggagaagaccaccaucuggacgagcggguccagcaucuccuucugcggcgucaacagcgacaccgugaacugguccuggcccgacggcgcggagcugccguucaccaucgacaaguga

SEQ ID NO: 76705 - RNA, 1413 nt, Artificial Sequence; identical to SEQ ID NO: 76067
  derived and/or modified sequence opt1 from neuraminidase__InfluenzaA__ABN50920

SEQ ID NO: 76706 - RNA, 1413 nt, Artificial Sequence
  derived and/or modified sequence opt1 from neuraminidase__InfluenzaA__ABN50931
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacgcagggggcccugcucaacgacaagcacagcaacggcaccgugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagacgaucaagagcuggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagagcaucgagcuggacgcccccaacucccacuacgaggagugcagcugcuaccccgacgccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagagcaacuccagccggcgcggcuucgagaugaucugggaccccaacggguggacggacaccgacuccaaguuccuggucaagcaggacgugguggccaucaccgacuggagcggcuacagcggcuccuucguccagcacccggagcugaccgggcucgacugcaugcggcccugcuucuggguggagcugauccgcggccggccccgcgagaacacgaccaucuggaccagcggguccagcaucuccuucugcggcgucaacggcgacaccgccaacuggagcuggcccgacggggccgagcugccguucacgaucgacaaguga

SEQ ID NO: 76707 - RNA, 1413 nt, Artificial Sequence
  derived and/or modified sequence opt1 from neuraminidase__InfluenzaA__ABN50943
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacgcagggggcccugcucaacgacaagcacagcaacggcaccgugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagacgaucaagagcuggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagagcaucgagcuggacgcccccaacucccacuacgaggagugcagcugcuaccccgacgccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagagcaacuccagccggcgcggcuucgagaugaucugggaccccaacggguggacggacaccgacuccaaguuccuggucaagcaggacgugguggccaugaccgacuggagcggcuacagcggcuccuucguccagcacccggagcugaccgggcucgacugcaugcggcccugcuucuggguggagcugauccgcggccggccccgcgagaacacgaccaucuggaccagcggguccagcaucuccuucugcggcgucaacggcgacaccgccaacuggagcuggcccgacggggccgagcugccguucacgaucgacaaguga

SEQ ID NO: 76708 - RNA, 1413 nt, Artificial Sequence; identical to SEQ ID NO: 75976
  derived and/or modified sequence opt1 from neuraminidase__InfluenzaA__ABN50954

SEQ ID NO: 76709 - RNA, 1413 nt, Artificial Sequence; identical to SEQ ID NO: 75976
  derived and/or modified sequence opt1 from neuraminidase__InfluenzaA__ABN50965

SEQ ID NO: 76710 - RNA, 1413 nt, Artificial Sequence; identical to SEQ ID NO: 75976
  derived and/or modified sequence opt1 from neuraminidase__InfluenzaA__ABN50976

SEQ ID NO: 76711 - RNA, 1410 nt, Artificial Sequence; identical to SEQ ID NO: 75351
  derived and/or modified sequence opt1 from neuraminidase__InfluenzaA__ABN50987

SEQ ID NO: 76712 - RNA, 1410 nt, Artificial Sequence; identical to SEQ ID NO: 75354
  derived and/or modified sequence opt1 from neuraminidase__InfluenzaA__ABN50998

SEQ ID NO: 76713 - RNA, 1410 nt, Artificial Sequence
  derived and/or modified sequence opt1 from neuraminidase__InfluenzaA__ABN51013
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccucugccuggaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 76714 - RNA, 1410 nt, Artificial Sequence
  derived and/or modified sequence opt1 from neuraminidase__InfluenzaA__ABN51024
augaaccccaaccagaagaucaucaccaucggcagcgugucccugaccgucagcacgaucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaccaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcacguccgggaccuacggcaccgggagcuggccggacggcgccgacaucaaccugaugcccaucuga

SEQ ID NO: 76715 - RNA, 1410 nt, Artificial Sequence
  derived and/or modified sequence opt1 from neuraminidase__InfluenzaA__ABN51035
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 76716 - RNA, 1410 nt, Artificial Sequence; identical to SEQ ID NO: 76715
  derived and/or modified sequence opt1 from neuraminidase__InfluenzaA__ABN51046

SEQ ID NO: 76717 - RNA, 1413 nt, Artificial Sequence
  derived and/or modified sequence opt1 from neuraminidase__InfluenzaA__ABN51069
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccgacaccggcaccgugaugugcgucugccgcgacaacuggcacgggagcaaccggcccuggguguccuucaaccagaaccuggacuaccagaucggcuacaucugcagcggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagauggugugggaccccaacggcuggaccgacaccgacagcgacuucuccaugaagcaggacaucguggccaugacggacuggagcggguacuccggcagcuucguccagcaccccgagcugaccggccuggacugcaugcggccgugcuucuggguggagcucgugcgcgggcugccccgggagaacaccaccaucuggacgagcggcuccagcaucuccuucugcggggucaacagcgacaccgccaacugguccuggcccgacggcgccgagcugcccuucaccaucgacaaguga

SEQ ID NO: 76718 - RNA, 1413 nt, Artificial Sequence
  derived and/or modified sequence opt1 from neuraminidase__InfluenzaA__ABN51080
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcgcacccaggagagcgagugcgugugcgugaacggcuccugcuucaccaucaugacggacggccccagcaacggggccgccuccuacaagaucuucaagaucgagaagggcaaggucaccaagagcguggagcucaacgcccccaacuuccacuacgaggagugcuccugcuacccggacaccgggaccgugaugugcgucugccgggacaacuggcacggcagcaaccgccccuggguguccuucaaccagaaccuggacuaccagaucggguacaucugcagcggcguguucggcgacaacccccggcccaaggacggggagggcuccugcaacccggucacgguggacggggcgaacggcgugaagggguucagcuacaaguacggcaacggcgucuggaucgggcgcaccaaguccaaccggcugcgcaagggcuucgagaugaucugggaccccaacggguggaccgacaccgacagcgacuucuccgugaagcaggacguggucgccaucacggacuggagcggcuacagcggguccuucgugcagcaccccgagcucaccggccuggacugcauccggcccugcuucugggucgagcuggugcgcggccucccgaaggagaacaccaccaucuggacgagcggguccagcaucuccuucugcggcgugaacagcgacaccgccaacugguccuggcccgacggggccgagcugcccuucaccaucgacaaguga

SEQ ID NO: 76719 - RNA, 1413 nt, Artificial Sequence; identical to SEQ ID NO: 75394
  derived and/or modified sequence opt1 from neuraminidase__InfluenzaA__ABN51091

SEQ ID NO: 76720 - RNA, 1410 nt, Artificial Sequence; identical to SEQ ID NO: 75103
  derived and/or modified sequence opt1 from neuraminidase__InfluenzaA__ABN51102

SEQ ID NO: 76721 - RNA, 1410 nt, Artificial Sequence; identical to SEQ ID NO: 75111
  derived and/or modified sequence opt1 from neuraminidase__InfluenzaA__ABN51113

SEQ ID NO: 76722 - RNA, 1410 nt, Artificial Sequence
  derived and/or modified sequence opt1 from neuraminidase__InfluenzaA__ABN51124
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcgucccgcaccggacgcugcugaugaacgagcucggcgugcccuuccaccuggggacccgccaggugugcaucgccuggagcuccagcuccugccacgacggcaaggcguggcugcacgucugcaucaccggggacgacaagaacgccaccgccagcuucaucuacgacggccggcucguggacuccaucgggagcuggucccagaacauccugcgcacgcaggagagcgagugcgugugcaucaacgggaccugcaccgucgugaugaccgacggcuccgccagcggccgggcggacacgcgcauccuguucaucgaggagggcaagaucgugcacaucagcccccucuccgggagcgcccagcacgucgaggagugcuccugcuacccccgguacccgggcgugcgcugcaucugccgggacaacuggaagggcagcaaccgccccguggucgacaucaacauggaggacuacuccaucgacagcuccuacgugugcagcgggcuggugggcgacacgccccggaacgacgaccgcuccagcaacuccaacugccggaaccccaacaacgagcgcgggaaccagggcgucaaggggugggccuucgacaacggcgacgacguguggaugggccggaccaucagcaaggaccugcgcuccggguacgagaccuucaaggucaucggcggguggagcaccccgaacuccaagagccagaucaaccgccaggugaucguggacuccgacaaccggagcggcuacuccgggaucuucagcgucgagggcaagagcugcaucaaccgcugcuucuacguggagcucauccggggccgcaagcaggagacccgggugugguggaccuccaacagcaucgucguguucugcgggaccuccggcacguacgggaccggcagcuggcccgacggggccaacaucaacuucaugcccaucuga

SEQ ID NO: 76723 - RNA, 1410 nt, Artificial Sequence; identical to SEQ ID NO: 75111
  derived and/or modified sequence opt1 from neuraminidase__InfluenzaA__ABN51135

SEQ ID NO: 76724 - RNA, 1413 nt, Artificial Sequence; identical to SEQ ID NO: 75404
  derived and/or modified sequence opt1 from neuraminidase__InfluenzaA__ABN51146

SEQ ID NO: 76725 - RNA, 1410 nt, Artificial Sequence
  derived and/or modified sequence opt1 from neuraminidase__InfluenzaA__ABN51157
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggagaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76726 - RNA, 1410 nt, Artificial Sequence; identical to SEQ ID NO: 76714
  derived and/or modified sequence opt1 from neuraminidase__InfluenzaA__ABN59393

SEQ ID NO: 76727 - RNA, 1365 nt, Artificial Sequence
  derived and/or modified sequence opt1 from neuraminidase__InfluenzaA__ABN59415
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuucgagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgggacaacuggcacggcagcaaccgccccuggguguccuucgaccagaaccucgacuaccagaucggguacaucugcagcggcgucuucggcgacaacccccggccggaggacgggaccggcuccugcgggcccguguacguggacggcgccaacggggucaagggcuucagcuaccgcuacggcaacgggguguggaucggccggaccaagucccacagcucccgccacggguucgagaugaucugggaccccaacggcuggaccgagacggacagcaaguucagcgugcggcaggacgucguggccaugaccgacugguccggguacagcggcuccuucgugcagcaccccgagcugaccggccuggacugcaugcgcccgugcuucugggucgagcucauccgggggcgccccaaggagaagaccaucuggacgagcgccuccagcaucuccuucugcggcgugaacagcgacaccgucgacugguccuggcccgacggggccgagcugcccuucagcaucgacaaguga

SEQ ID NO: 76728 - RNA, 1413 nt, Artificial Sequence; identical to SEQ ID NO: 75959
  derived and/or modified sequence opt1 from neuraminidase__InfluenzaA__ABN59426

SEQ ID NO: 76729 - RNA, 1410 nt, Artificial Sequence; identical to SEQ ID NO: 75261
  derived and/or modified sequence opt1 from neuraminidase__InfluenzaA__ABO32659

SEQ ID NO: 76730 - RNA, 1410 nt, Artificial Sequence
  derived and/or modified sequence opt1 from neuraminidase__InfluenzaA__ABO32670
augaaccccaaccagaagaucaucaccaucggcagcgugucccugaccaucagcacgaucugcuucuucaugcagaucgccauccucgucaccaccgugacccugcacuucaagcaguacgagugcaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacggccacuccaacgacaccguccacgaccgcaccccguaccggacccugcucaugaacgagcugggcgugcccuuccacauggggacgaagcaggucugcaucgccuggagcuccagcuccugccacgacggcaaggccuggcugcacgugugcgugaccggggacgacgagaacgcgaccgccagcuucaucuacaacggccgccucguggacuccaucgggagcugguccaagaagauccugcggacccaggagagcgagugcgucugcaucaacggcacgugcaccguggugaugaccgacggcuccgccagcgggaaggccgacaccaagauccuguucaucgaggagggcaagaucguccacacgagcacccucuccgggagcgcgcagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcuggugggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcuccgcuccggcuacgagaccuucaaggugaucgagggguggagcaagcccaacuccaagcugcagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugcucuggaccuccaacagcaucguggucuucugcggcaccuccgggacguacggcaccgggagcuggccggacggcgccgacaucaaccugaugcccaucuga

SEQ ID NO: 76731 - RNA, 1413 nt, Artificial Sequence; identical to SEQ ID NO: 76582
  derived and/or modified sequence opt1 from neuraminidase__InfluenzaA__ABO32681

SEQ ID NO: 76732 - RNA, 1410 nt, Artificial Sequence
  derived and/or modified sequence opt1 from neuraminidase__InfluenzaA__ABO32695
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugcagcgaccccaacaacgaggagggcgggcacggggucaagggcugggccuucgacgacgggaacgacguguggaugggccggaccaucuccgagaagcuccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 76733 - RNA, 1410 nt, Artificial Sequence; identical to SEQ ID NO: 75738
  derived and/or modified sequence opt1 from neuraminidase__InfluenzaA__ABO32754

SEQ ID NO: 76734 - RNA, 1410 nt, Artificial Sequence; identical to SEQ ID NO: 75738
  derived and/or modified sequence opt1 from neuraminidase__InfluenzaA__ABO32765

SEQ ID NO: 76735 - RNA, 1410 nt, Artificial Sequence; identical to SEQ ID NO: 76610
  derived and/or modified sequence opt1 from neuraminidase__InfluenzaA__ABO32778

SEQ ID NO: 76736 - RNA, 1410 nt, Artificial Sequence
  derived and/or modified sequence opt1 from neuraminidase__InfluenzaA__ABO32793
augaaccccaaccagaagaucaucaccaucggcagcgugucccugaccaucagcacgaucugcuucuucaugcagaucgucauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcccccuucuccaaggacaacagcauccgccuguccgcgggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgccaccgcgagcuucaucuacaacgggcgccuggucgacuccaucgugagcugguccaaggagauccugcggacccaggagagcgagugcgugugcaucaacggcacgugcaccgucgugaugaccgacggguccgccagcggcaagaccgacacgaagauccucuucaucgaggagggcaagaucgugcacaccagcacccuguccgggagcgcccagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcacguccgggaccuacggcaccgggagcuggccggacggcgcggacaucaaccugaugcccaucuga

SEQ ID NO: 76737 - RNA, 1410 nt, Artificial Sequence; identical to SEQ ID NO: 75335
  derived and/or modified sequence opt1 from neuraminidase__InfluenzaA__ABO32806

SEQ ID NO: 76738 - RNA, 1410 nt, Artificial Sequence; identical to SEQ ID NO: 75722
  derived and/or modified sequence opt1 from neuraminidase__InfluenzaA__ABO32819

SEQ ID NO: 76739 - RNA, 1410 nt, Artificial Sequence; identical to SEQ ID NO: 75354
  derived and/or modified sequence opt1 from neuraminidase__InfluenzaA__ABO32830

SEQ ID NO: 76740 - RNA, 1410 nt, Artificial Sequence; identical to SEQ ID NO: 75720
  derived and/or modified sequence opt1 from neuraminidase__InfluenzaA__ABO32841

SEQ ID NO: 76741 - RNA, 1410 nt, Artificial Sequence; identical to SEQ ID NO: 75720
  derived and/or modified sequence opt1 from neuraminidase__InfluenzaA__ABO32852

SEQ ID NO: 76742 - RNA, 1410 nt, Artificial Sequence; identical to SEQ ID NO: 75720
  derived and/or modified sequence opt1 from neuraminidase__InfluenzaA__ABO32863

SEQ ID NO: 76743 - RNA, 1410 nt, Artificial Sequence; identical to SEQ ID NO: 76714
  derived and/or modified sequence opt1 from neuraminidase__InfluenzaA__ABO32874

SEQ ID NO: 76744 - RNA, 1410 nt, Artificial Sequence; identical to SEQ ID NO: 76714
  derived and/or modified sequence opt1 from neuraminidase__InfluenzaA__ABO32885

SEQ ID NO: 76745 - RNA, 1410 nt, Artificial Sequence; identical to SEQ ID NO: 76715
  derived and/or modified sequence opt1 from neuraminidase__InfluenzaA__ABO32896

SEQ ID NO: 76746 - RNA, 1410 nt, Artificial Sequence; identical to SEQ ID NO: 76715
  derived and/or modified sequence opt1 from neuraminidase__InfluenzaA__ABO32907

SEQ ID NO: 76747 - RNA, 1410 nt, Artificial Sequence
  derived and/or modified sequence opt1 from neuraminidase__InfluenzaA__ABO32918
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaacuccaacagcaagcugcagaccaaccgccaggugaucguggaccggggcaaccgguccggguacagcggcaucuucagcgucgaggggaaguccugcaucaaccgcugcuucuacguggagcucauccggggccgcaaggaggagaccgaggugcuguggacgagcaacuccaucgucguguucugcggcaccagcgggaccuacggcaccggguccuggcccgacggcgccgacaucaaccugaugccgaucuga

SEQ ID NO: 76748 - RNA, 1410 nt, Artificial Sequence; identical to SEQ ID NO: 76747
  derived and/or modified sequence opt1 from neuraminidase__InfluenzaA__ABO32929

SEQ ID NO: 76749 - RNA, 1410 nt, Artificial Sequence; identical to SEQ ID NO: 76747
  derived and/or modified sequence opt1 from neuraminidase__InfluenzaA__ABO32940

SEQ ID NO: 76750 - RNA, 1413 nt, Artificial Sequence
  derived and/or modified sequence opt1 from neuraminidase__InfluenzaA__ABO32951
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 76751 - RNA, 1413 nt, Artificial Sequence
  derived and/or modified sequence opt1 from neuraminidase__InfluenzaA__ABO32962
augaaccccaaccagaagaucaucaccaucggcagcaucuccaucgccaucgggaucaucagccugaugcuccagaucggcaacaucaucuccaucugggccagccacuccauccagaccgggagcaagaaccacacgggcgugugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccaacgccugccacgacggcaugggcuggcucaccaucgggaucuccggccccgacaacggggcggucgccgugcugaaguacaacggcaucaucacggagaccaucaagagcuggaagaagcagauccugcgcacccaggaguccgagugcgugugcgucaacggcagcugcuucaccaucaugacggacgggcccuccaacggcgccgccagcuacaagaucuucaagaucaagaaggggaaggugaccaaguccaucgagcucaacgcccccaacuuccacuacgaggagugcagcugcuacccggacaccggcaccgugaugugcgucugccgggacaacuggcacggguccaaccgccccugggugagcuucaaccagaaccuggacuaccagaucggcuacaucugcuccggcguguucggggacaacccccggcccaaggacggcgaggggagcugcaacccggucacgguggacggcgcgaacggggugaagggcuucuccuacaaguacggcaacggggucuggaucggccgcaccaagagcaaccggcugcgcaagggguucgagaugaucugggaccccaacggcuggaccgacaccgacuccgacuucagcgugcggcaggacguggucgccaucacggacugguccggguacagcggcagcuucgugcagcaccccgagcucaccggccuggacugcauccgccccugcuucugggucgagcuggugcgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 76752 - RNA, 1413 nt, Artificial Sequence; identical to SEQ ID NO: 75394
  derived and/or modified sequence opt1 from neuraminidase__InfluenzaA__ABO32973

SEQ ID NO: 76753 - RNA, 1413 nt, Artificial Sequence; identical to SEQ ID NO: 75959
  derived and/or modified sequence opt1 from neuraminidase__InfluenzaA__ABO32984

SEQ ID NO: 76754 - RNA, 1413 nt, Artificial Sequence; identical to SEQ ID NO: 75959
  derived and/or modified sequence opt1 from neuraminidase__InfluenzaA__ABO32995

SEQ ID NO: 76755 - RNA, 1413 nt, Artificial Sequence
  derived and/or modified sequence opt1 from neuraminidase__InfluenzaA__ABO33009
augaaccccaaccagaagaucaucaccaucggcagcaucugcauggccaucgggaugaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcagcugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggagcaaccgccccuggguguccuucaaccagaaccucgacuaccagaucggcuacaucugcagcggcgucuucggggacaacccgcggcccaaggacggcaagggguccugcgaccccgugaacguggacggcgccgacggggucaagggcuucagcuaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggagcggguacuccggcagcuucgugcagcacccggagcugacgggccucgacugcaugcggcccugcuucugggucgagcugauccgcgggcggccccgcgagaagaccaccaucuggaccuccggcagcuccaucagcuucugcggggugaacuccgacacggucaacuggagcuggcccgacggcgcggagcugccguucaccaucgacaaguga

SEQ ID NO: 76756 - RNA, 1410 nt, Artificial Sequence; identical to SEQ ID NO: 76526
  derived and/or modified sequence opt1 from neuraminidase__InfluenzaA__ABO33039

SEQ ID NO: 76757 - RNA, 1410 nt, Artificial Sequence
  derived and/or modified sequence opt1 from neuraminidase__InfluenzaA__ABO33050
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacagcaagcuccagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcuguggaccagcaacuccaucgucguguucugcggcaccagcgggaccuacggcacgggguccuggcccgacggcgccgacaucaaccucaugcccaucuga

SEQ ID NO: 76758 - RNA, 1410 nt, Artificial Sequence; identical to SEQ ID NO: 75738
  derived and/or modified sequence opt1 from neuraminidase__InfluenzaA__ABO33061

SEQ ID NO: 76759 - RNA, 1410 nt, Artificial Sequence
  derived and/or modified sequence opt1 from neuraminidase__InfluenzaA__ABO33072
augaaccccaaccagaagaucaucaccaucggcagcgugucccugaccaucgccacgaucugcuuccucaugcagaucgccauccuggucaccaccgugacccugcacuucaagcaguacgagugcgggagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggcuucgcccccuucagcaaggacaacuccauccgccugagcgccgggggcgacaucugggugacccgggagcccuacgucuccugcgaccccgggaagugcuaccaguucgcccucggccagggcaccacccuggacaacaagcacagcaacgacacgauccacgaccgcaccccgcaccggacccugcucaugaacgagcugggggugcccuuccaccugggcacccgccaggugugcaucgccugguccagcuccagcugccacgacgggaaggcguggcuccacgucugcgugacgggcuacgacaagaacgccaccgccuccuucaucuacgacgggcggcugguggacagcaucggcuccuggagcaagaacauccugcgcacccaggaguccgagugcgucugcaucaacgggaccugcacgguggugaugaccgacggcagcgccuccgagcgggcggacaccaagauccucuucaucgaggagggcaagaucguccacaucagcccccugagcggguccgcccagcacguggaggagugcagcugcuacccccgcuacccgggcgugcggugcgucugccgcgacaacuggaagggcuccaaccggcccgugguggacaucaacgucaaggacuacagcaucguguccagcuacgugugcuccgggcuggucggcgacacgccccgcaagaacgaccggagcuccagcuccuacugccgcaaccccaacaacgagaaggggaaccacggcgugaaggggugggccuucgacgacggcaacgacgucuggaugggccggaccaucagcgaggagucccgcagcggguacgagaccuucaaggugaucggcgggugguccaccccgaacagcaagcuccagaucaaccgccaggugaucgucgacuccgacaaccggagcggcuacuccgggaucuucagcguggagggcaagagcugcaucaaccggugcuucuacguggagcugauccgcggccgcgagcaggagacccgggucugguggacguccaacagcaucgugguguucugcgggaccuccggcaccuacgggaccggcagcuggcccgacggggccgacaucaaccugaugcccaucuga

SEQ ID NO: 76760 - RNA, 1413 nt, Artificial Sequence; identical to SEQ ID NO: 76067
  derived and/or modified sequence opt1 from neuraminidase__InfluenzaA__ABO37991

SEQ ID NO: 76761 - RNA, 1413 nt, Artificial Sequence
  derived and/or modified sequence opt1 from neuraminidase__InfluenzaA__ABO38013
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccgacaccggcaccgugaugugcgucugccgcgacaacuggcacgggagcaaccggcccuggguguccuucaaccagaaccuggacuaccagaucggcuacaucugcagcggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguacgagaugaucugggaccccaacggcuggaccgacaccgacagcgacuucuccaugaagcaggacaucguggccaugacggacuggagcggguacuccggcagcuucgugcagcaccccgagcugaccggccuggacugcaugcggccgugcuucugggucgagcucgugcgcgggcugccccgggagaacaccaccaucuggacgagcggcuccagcaucuccuucugcggggugaacagcgacaccgccaacugguccuggcccgacggcgccgagcugcccuucaccaucgacaaguga

SEQ ID NO: 76762 - RNA, 1413 nt, Artificial Sequence
  derived and/or modified sequence opt1 from neuraminidase__InfluenzaA__ABO38024
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacaacaccugggugaaccacaccuacgucaacaucaacaacacgaacaucguggcggggaaggacaagaccuccgugacccuggccggcaacagcucccugugcagcaucuccggcugggccaucuacaccaaggacaacagcauccggaucggguccaagggcgacgucuucgugauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccuccccguacaacagcaaguucgagagcgucgccugguccgccagcgccugccacgacggcaugggcuggcucaccaucgggaucuccggccccgacaacggggcgguggccgugcugaaguacaacggcaucaucacggagaccaucaagagcuggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccaucgagcucaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcgaggggagcugcaacccggugacgguggacggcgcggacggggucaagggcuucuccuacaaguacggcaacgggguguggaucggccggaccaagagcaaccgccugcggaagggguucgagauggugugggaccccaacggcuggaccgacaccgacuccgacuucagcgucaagcaggacgugguggccaucacggacugguccggguacagcggcagcuucguccagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 76763 - RNA, 1413 nt, Artificial Sequence
  derived and/or modified sequence opt1 from neuraminidase__InfluenzaA__ABO38035
augaaccccaaccagaagaucaucaccaucggcagcaucuccaucgccaucgggaucaucagccugaugcuccagaucggcaacaucaucuccaucugggccagccacuccauccagaccgggagccagaaccacacggggaccugcaaccagcgcaucaucaccuacgagaacuccaccugggugaaccacacguacgucaacaucaacaacaccaacgugguggcgggcaaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugaccgucgacggcgcggacggggugaagggcuucagcuacaaguacggcaacgggguguggaucggccggaccaaguccaaccgccugcggaagggguucgaggucaucugggaccccaacggcuggaccgacacggacagcgacuucuccgugaagcaggacguggucgccaucaccgacuggagcggguacagcggcuccuucgugcagcaccccgagcucaccggccuggacugcauccgccccugcuucugggucgagcuggugcgggggaugccgcgcgagaacaccacgaucuggaccagcggcuccagcaucuccuucugcggggugaacagcgacaccgccaacugguccuggcccgacggcgccgagcuccccuucaccaucgacaaguga

SEQ ID NO: 76764 - RNA, 1413 nt, Artificial Sequence; identical to SEQ ID NO: 75404
  derived and/or modified sequence opt1 from neuraminidase__InfluenzaA__ABO38046

SEQ ID NO: 76765 - RNA, 1413 nt, Artificial Sequence; identical to SEQ ID NO: 75959
  derived and/or modified sequence opt1 from neuraminidase__InfluenzaA__ABO38068

SEQ ID NO: 76766 - RNA, 1410 nt, Artificial Sequence; identical to SEQ ID NO: 75335
  derived and/or modified sequence opt1 from neuraminidase__InfluenzaA__ABO38079

SEQ ID NO: 76767 - RNA, 1410 nt, Artificial Sequence
  derived and/or modified sequence opt1 from neuraminidase__InfluenzaA__ABO38090
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 76768 - RNA, 1410 nt, Artificial Sequence
  derived and/or modified sequence opt1 from neuraminidase__InfluenzaA__ABO38101
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacccgggugugguggaccuccaacagcaucguggucuucugcgggaccuccggcacguacgggaccggcagcuggcccgacggggccaacaucaacuucaugccgaucuga

SEQ ID NO: 76769 - RNA, 1410 nt, Artificial Sequence
  derived and/or modified sequence opt1 from neuraminidase__InfluenzaA__ABO38233
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagcaagaacauccugcgcacccaggaguccgagugcgucugcaucaacgggaccugcacgguggugaugaccgacggcagcgccuccgagcgggcggacaccaagauccucuucaucgaggaggggaagaucguccacaucagcccccugagcggcuccgcccagcacguggaggagugcagcugcuacccccgcuacccgggggugcggugcgucugccgcgacaacuggaagggcuccaaccggcccgugguggacaucaacgucaaggacuacagcaucgccuccagcuacgugugcuccggccuggugggggacacgccccgcaagaacgaccgguacagcuccagcuacugccgcaaccccaacaacgagaagggcaaccacggggucaagggcugggccuucgacgacgggaacgacguguggaugggccggaccaucuccgacgagagccgcuccggcuacgagaccuucaaggucaucgggggcuggagcaccccgaacuccaagcuccagaucaaccgccaggugaucguggacagcgacaaccgguccggguacagcggcaucuucuccgucgagggcaagagcugcaucaaccggugcuucuacguggagcugauccgcggccgcgagcaggagacccgggugugguggacgagcaacuccaucgucguguucugcggcaccagcgggaccuacggcaccggguccuggcccgacggcgccgacaucaaccugaugcccaucuga

SEQ ID NO: 76770 - RNA, 1410 nt, Artificial Sequence; identical to SEQ ID NO: 76119
  derived and/or modified sequence opt1 from neuraminidase__InfluenzaA__ABO38244

SEQ ID NO: 76771 - RNA, 1410 nt, Artificial Sequence; identical to SEQ ID NO: 75335
  derived and/or modified sequence opt1 from neuraminidase__InfluenzaA__ABO38255

SEQ ID NO: 76772 - RNA, 1410 nt, Artificial Sequence; identical to SEQ ID NO: 75720
  derived and/or modified sequence opt1 from neuraminidase__InfluenzaA__ABO38277

SEQ ID NO: 76773 - RNA, 1410 nt, Artificial Sequence; identical to SEQ ID NO: 76747
  derived and/or modified sequence opt1 from neuraminidase__InfluenzaA__ABO38288

SEQ ID NO: 76774 - RNA, 1410 nt, Artificial Sequence
  derived and/or modified sequence opt1 from neuraminidase__InfluenzaA__ABO38299
augaaccccaaccagaagaucaucaccaucggcagcgugucccugaccaucgccacggucugcuucaucaugcagaucgccauccucgcgaccaccgugacccugcacuucaagcagcacgagugcgacagcccggccuccaaccaggugaugcccugcgagcccaucaucaucgagcgcaacaucacggagaucgucuaccugaacaacaccaccaucgagaaggagaucugccccgaggccguggaguaccggaacuggagcaagccgcagugccagaucaccggguucgcccccuucuccaaggacaacagcauccgccucuccgccggcggggacaucugggugacgcgggagcccuacgucagcugcgaccccggcaagugcuaccaguucgcgcuggggcagggcaccacccuggacaacaagcacuccaacggcaccauccacgaccgcaucccgcaccggacgcuccugaugaacgagcugggggugcccuuccaccucggcaccaagcaggucugcguggccuggagcuccagcuccugccacgacgggaaggccuggcugcacgugugcgugaccggcgacgaccgcaacgccaccgcgagcuucaucuacgacgggcggcuggucgacuccaucggcagcuggucccagaacauccuccgcacgcaggagagcgagugcgugugcaucaacgggaccugcaccguggucaugaccgacggcuccgccagcggccgggccgacacgcgcauccuguucaucaaggaggggaagaucgugcacaucagcccccuguccggcagcgcccagcacguggaggagugcuccugcuacccccgguacccggacguccgcugcacgugccgggacaacuggaagggcagcaaccgccccgugaucgacaucaacauggaggacuacuccaucgacagcuccuacgugugcagcgggcucgucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacccgggugugguggaccuccaacagcaucguggucuucugcgggaccuccggcaccuacgggaccggcagcuggcccgacggggcgaacaucaacuucaugccgaucuga

SEQ ID NO: 76775 - RNA, 1410 nt, Artificial Sequence
  derived and/or modified sequence opt1 from neuraminidase__InfluenzaA__ABO38310
augaaccccaaccagaagaucaucaccaucggcagcgugucccugaccaucgccacggucugcuuccucaugcagaucgccauccuggcgaccaccgugacccugcacuucaagcagcacgagugcgacagcccgacguccaaccaggugaugcccugcgagcccaucaucaucgagcgcaacaucaccgagaucgucuaccucaacaacaccaccaucgagaaggagaucugccccgaggugguggaguaccggaacuggagcaagccgcagugccagaucacgggguucgcccccuucuccaaggacaacagcauccgccuguccgccggcggggacaucugggucacccgggagcccuacgugagcugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggccuggagcuccagcuccugccacgacgggaaggcguggcugcacgugugcgucaccggcgacgaccgcaacgccacggccagcuucaucuacgacgggcggcucguggacuccaucggcagcuggucccagaacauccugcgcacccaggagagcgagugcgugugcaucaacgggaccugcaccgucgugaugacggacggcuccgccagcggccgggcggacacccgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacggggacuccagcuccaacagcaacugccgcgaccccaacaacgagcggggcaacccgggggugaagggcugggccuucgacaacggcgacgacguguggauggggcgcaccaucaacaaggagucccggagcggcuacgagaccuucaaggucaucgggggcugguccacccccaacagcaagucccaggugaaccgccaggucaucguggacaacaacaacuggagcggguacuccggcaucuucagcguggagggcaagagcugcaucaaccggugcuucuacgucgagcugauccgcgggcgcccccaggagacccgggugugguggaccuccaacagcaucguggucuucugcggcacguccgggaccuacggcaccgggagcuggcccgacggcgccaacaucaacuucaugccgaucuga

SEQ ID NO: 76776 - RNA, 1413 nt, Artificial Sequence; identical to SEQ ID NO: 75938
  derived and/or modified sequence opt1 from neuraminidase__InfluenzaA__ABO38332

SEQ ID NO: 76777 - RNA, 1413 nt, Artificial Sequence
  derived and/or modified sequence opt1 from neuraminidase__InfluenzaA__ABO38343
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccagcaacggcccggcguccuaccggaucuucaagaucgagaaggggaagaucaccaagagcaucgagcuggacgcccccaacucccacuacgaggagugcagcugcuaccccgacaccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggaccgacacggacuccaacuuccuggucaagcaggacgugguggccaugaccgacuggagcggguacagcggcuccuucguccagcacccggagcugaccggccucgacugcaugcgccccugcuucuggguggagcugguccgggggcgcccccgggagggcaccacgguguggaccagcggguccagcaucuccuucugcggcgugaacagcgacaccgccaacugguccuggcccgacggcgcggagcugccguucaccaucgacaaguga

SEQ ID NO: 76778 - RNA, 1410 nt, Artificial Sequence
  derived and/or modified sequence opt1 from neuraminidase__InfluenzaA__ABO38354
augaaccccaaccagaagaucaucaccaucggcagcaucugcaugguggucgggaucaucucccugauccuccagaucggcaacaucaucagcaucuggaucucccacagcauccagaccgggucccagaaccacacgggcaucugcaaccagaacaucaucaccuacaagaacagcaccugggugaaccagaccuacgugaacaucuccaacacgaacgucguggccgggcaggacaccaccagcgugauccugaccggcaacuccagccugugcccgauccgcggcugggccaucuacuccaaggacaacagcauccggaucggguccaagggcgacgucuucgugauccgcgagcccuucaucagcugcucccaccucgagugccggacguucuuccugacccagggggcgcugcucaacgaccgccacagcaacggcaccgugaaggaccggucccccuaccgcgcccugaugagcugccccgucggggaggccccgucccccuacaacagccgguucgagagcguggccugguccgccagcgcgugccacgacggcaugggcuggcugaccaucgggaucuccggccccgacaacggggccguggccguccucaaguacaacggcaucaucacggagaccaucaagagcuggcgcaagaagauccugcggacccaggaguccgagugcgccugcgugaacggcagcugcuucaccaucaugacggacgggcccuccaacggccuggcgagcuacaagaucuucaagaucgagaaggggaaggugaccaaguccaucgagcucaacgccccgaacagccacuacgaggagugcuccugcuaccccgacaccggcaaggucaugugcgugugccgcgacaacuggcacgggagcaaccggcccuggguguccuucgaccagaaccuggacuaccagaucggcuacaucugcagcggcgucuucggggacaacccccgcccgaaggacggcaccggguccugcggccccguguacguggacggggccaacggcgucaagggcuucagcuaccgguacgggaacggcguguggaucgggcgcacgaaguccaacagcucccggcacggcuucgagaugaucugggaccccaacggguggaccgagaccgacagcaaguucagcgugcgccaggacgucguggccaugaccgacugguccggcuacagcggcuccuucguccagcaccccgagcugacggggcucgacugcaugcggccgugcuucuggguggagcugauccgcggccggcccaaggagaacaccaucuggaccagcggguccagcaucuccuucugcggcgugaacagcgacaccgucgacugguccuggcccgacggcgccgagcugcccuucacgaucgacaaguga

SEQ ID NO: 76779 - RNA, 1413 nt, Artificial Sequence
  derived and/or modified sequence opt1 from neuraminidase__InfluenzaA__ABO38365
augaaccccaaccagaagaucaucaccaucggcagcaucugcauggccaucgggaucaucucccugauccuccagaugggcaacaucaucagcaucugggugucccacagcauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacagcucccugugcccgauccggggcugggccaucuacagcaaggacaacuccauccgcaucgggagcaagggcgacguguucgucauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagagcgagugcgugugcgucaacggcuccugcuucaccaucaugacggacgggcccagcaacggcccggccuccuaccggaucuucaagaucgagaaggggaagaucaccaagagcaucgagcuggacgcccccaacucccacuacgaggagugcagcugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugacggucgacggcgccgacggggugaagggcuucuccuaccgguacggcaacgggguguggaucggccgcaccaagagcaacuccagccggaagggguucgagaugaucugggaccccaacggcuggaccgacaccgacuccaacuuccuggucaagcaggacgugguggccaugacggacuggagcggguacagcggcuccuucguccagcacccggagcugaccggccucgacugcaugcgccccugcuucuggguggagcugauccgggggcgcccccgggagaagaccaccaucuggacgagcggcuccagcaucuccuucugcggggucaacagcgacaccgcgaacugguccuggcccgacggcgccgagcugccguucaccaucgacaaguga

SEQ ID NO: 76780 - RNA, 1410 nt, Artificial Sequence
  derived and/or modified sequence opt1 from neuraminidase__InfluenzaA__ABO38376
augaaccccaaccagaagaucaucaccaucggcagcaucugcaugguggucgggaucaucucccugauccuccagaucggcaacaucaucagcaucuggaucucccacagcauccagaccgggucccagaaccacacggggaccugcaaccagagcaucaucaccuacaagaacuccaccugggugaaccagacguacgugaacaucagcaacaccaacgucguggccggcaaggacaccaccuccgugauccuggccggcaacagcucccugugcccgauccgcggcugggcgaucuacagcaaggacaacgggguccggaucggcuccaagggggacguguucgugauccgcgagcccuucaucagcugcucccaccucgagugccggacguucuuccugacccagggcgcccugcucaacgacaagcacagcaacgggaccgucaaggaccgcucccccuaccgggcccugaugagcugccccgugggcgaggccccgucccccuacaacagccgcuucgagagcguggccugguccgcgagcgccugccacgacggcaugggguggcugaccaucggcaucuccgggcccgacgacggcgccgucgccgugcucaaguacaacggcaucaucacggagaccaucaagagcuggcggaaggagauccugcgcacccaggaguccgagugcgcgugcgugaacgggagcugcuucaccaucaugacggacggccccuccgggggcccggccagcuacaagaucuucaagaucgagaaggggaaggucaccaaguccaucgagcuggacgcccccaacagccacuacgaggagugcuccugcuaccccgacaccggcaaggugaugugcgugugccgggacaacuggcacggcagcaaccgccccugggucuccuucgaccagaaccucgacuaccagaugggguacaucugcagcggcguguucggggacaacccgcggcccaaggacggcaaggggaacugcggccccguguacgucgacggcgccaacggggugaagggcuucuccuaccgcuacgggaacggcguguggaucgggcggaccaagagcaacuccagccgccagggcuucgagaugaucugggaccccaacggcuggacggagaccgacuccaacuucuucgucaagcaggacguggucgccgugaccgacuggagcggguacagcggcuccuucgugcagcacccggagcugaccgggcuggacugcaugcggcccugcuucugggucgagcucauccgcggccggcccaaggagaagacgaucuggaccagcggcuccagcaucuccuucugcggggugaacagcgacaccguggacugguccuggcccgacggcgcggagcugccguucaccaucgacaaguga

SEQ ID NO: 76781 - RNA, 1410 nt, Artificial Sequence
  derived and/or modified sequence opt1 from neuraminidase__InfluenzaA__ABO38387
augaaccccaaccagaagaucaucaccaucggcagcaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucagcaacacgaacgucguggccgggcaggacaccaccuccgugauccugaccggcaacagcucccugugcccgauccgcggcugggccaucuacagcaaggacaacgggauccggaucggcuccaagggggacgucuucgugauccgcgagcccuucaucagcugcucccaccucgagugccggacguucuuccugacccagggcgcgcugcucaacgacaagcacagcaacgggaccgugaaggaccgcucccccuaccgggcccugaugagcugccccgucggcgaggccccgucccccuacaacagccgcuucgagagcguggccugguccgccagcgcgugccacgacggcaugggguggcugaccaucggcaucuccgggcccgacaacgaggccguggccguccucaaguacaacggcaucaucacggagaccaucaagagcuggcggaagaagauccugcgcacccaggaguccgagugcgccugcgugaacggcagcugcuucaccaucaugacggacgggcccuccgacggccuggcgagcuacaagaucuucaagaucgagaaggggaaggugaccaaguccaucgagcucaacgccccgaacagccacuacgaggagugcuccugcuaccccgacaccggcaaggucaugugcgugugccgggacaacuggcacgggagcaaccgccccuggguguccuucgaccagaaccuggacuaccagaucggcuacaucugcagcggcgucuucggggacaacccccggccgaaggacggcaccggguccugcggccccguguacguggacggggccaacggcgucaagggcuucagcuaccgcuacgggaacggcguguggaucgggcggacgaaguccaccagcucccgccacggcuucgagaugaucugggaccccaacggguggaccgagaccgacagcaaguucagcgugcggcaggacgucguggccaugacggacugguccggcuacagcggcuccuucguccagcaccccgagcugaccgggcucgacugcaugcgcccgugcuucuggguggagcugauccggggccagcccaaggagaagaccaucuggaccagcggguccagcaucuccuucugcggcgugaacagcgacacggucgacugguccuggcccgacggcgccgagcugcccuucaccaucgacaaguga

SEQ ID NO: 76782 - RNA, 1413 nt, Artificial Sequence
  derived and/or modified sequence opt1 from neuraminidase__InfluenzaA__ABO38398
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaacuucuuccugacccagggggcccugcucaacgacaagcacagcaacggcacggugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagaccaucaagagcuggcggaagcgcauccugcggacgcaggaguccgagugcgugugcgucaacggcagcugcuucaccaucaugaccgacgggcccaacaacggcccggccuccuacaagaucuucaagaucgagaaggggaagaucaccaagagcaucgagcuggacgcccccaacucccacuacgaggagugcagcugcuaccccgacgccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugaccgucgacggcgcggacggggugaagggcuucuccuaccgguacggcaacgggguguggaucggccgcaccaagagcaacuccagccggcgcggguucgagaugaucugggaccccaacggcuggaccgacacggacuccaaguuccuggucaagcaggacgugguggccaugaccgacuggagcggguacagcggcuccuucguccagcacccggagcugaccggccucgacugcaugcggcccugcuucuggguggagcugauccgcgggcggccccgcgagaacaccacgaucuggaccagcggcuccagcaucuccuucugcggggucaacggcgacaccgccaacuggagcuggcccgacggcgccgagcugccguucaccaucgacaaguga

SEQ ID NO: 76783 - RNA, 1410 nt, Artificial Sequence; identical to SEQ ID NO: 75261
  derived and/or modified sequence opt1 from neuraminidase__InfluenzaA__ABO38420

SEQ ID NO: 76784 - RNA, 1410 nt, Artificial Sequence
  derived and/or modified sequence opt1 from neuraminidase__InfluenzaA__ABO38715
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaccugccccaagguggucgaguaccggagcugguccaagccgcagugcaagaucacgggguucgcccccuucagcaaggacaacuccauccgccugagcgccggcggggacaucugggugacccgggagcccuacguguccugcgaccccggcaagugcuaccaguucgcccuggggcagggcaccacccucgacaacaagcacagcaacgacacgauccacgaccgcaucccgcaccggacccugcugaugaacgagcucggcguccccuuccaccuggggacccgccaggugugcaucgccugguccagcuccagcugccacgacggcaaggcguggcugcacgugugcgucaccggggacgacaagaacgccacggccuccuucaucuacgacggccggcucguggacagcaucggguccuggagccagaacauccugcgcacccaggaguccgagugcgugugcaucaacgggaccugcaccgucgugaugacggacggcagcgccagcggccgggcggacacccgcauccuguucaucgaggagggcaagaucgugcacaucagcccccucuccggguccgcccagcacgucgaggagugcagcugcuacccccgguacccggacgugcgcugcaucugccgggacaacuggaagggcuccaaccgccccaucguggacaucaacauggaggacuacagcaucgacuccagcuacgucugcuccggccuggugggggacacgccccggaacgacgaccgcagcuccaacagcaacugccggaaccccaacaacgagcgcggcaaccagggggugaagggcugggccuucgacaacggggacgacgucuggaugggccggaccaucuccaaggaccugcgcagcggcuacgagaccuucaaggugaucgggggcugguccaccccgaacagcaagucccagaucaaccggcaggucaucguggacagcgacaaccgcuccggguacagcggcaucuucagcguggaggggaaguccugcaucaaccgcugcuucuacgucgagcucauccggggccgcaagcaggagacccgggugugguggaccagcaacuccaucguggucuucugcggcacgagcgggaccuacggcaccggguccuggcccgacggcgccaacaucaacuucaugcccaucuga

SEQ ID NO: 76785 - RNA, 1410 nt, Artificial Sequence; identical to SEQ ID NO: 76784
  derived and/or modified sequence opt1 from neuraminidase__InfluenzaA__ABO38726

SEQ ID NO: 76786 - RNA, 1413 nt, Artificial Sequence
  derived and/or modified sequence opt1 from neuraminidase__InfluenzaA__ABO44049
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaucugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 76787 - RNA, 1410 nt, Artificial Sequence
  derived and/or modified sequence opt1 from neuraminidase__InfluenzaA__ABO44060
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugcaagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcgucaccggggacgacaagaacgccaccgccagcuucaucuacgacggccggcucguggacuccaucgggagcuggucccagaacauccugcgcacgcaggagagcgagugcgugugcaucaacgggaccugcaccgucgugaugaccgacggcuccgccagcgggcgggcggacacgaagauccuguucaucgaggagggcaagaucgugcacaucagcccccucuccgggagcgcccagcacgucgaggagugcuccugcuacccccgcuacccggacgugcggugcaucugccgcgacaacuggaagggcagcaaccggcccguggucgacaucaacauggaggacuacuccaucgacagcuccuacgugugcagcggccuggugggggacacgccccgcaacgacgaccgguccagcaacuccaacugccgcaaccccaacaacgagcggggcaaccagggggucaagggcugggccuucgacaacggggacgacguguggaugggccgcaccaucagcaaggaccugcgguccggcuacgagaccuucaaggucaucgggggcuggagcaccccgaacuccaagagccagaucaaccgccaggugaucguggacuccgacaaccggagcggguacuccggcaucuucagcgucgagggcaagagcugcaucaaccgcugcuucuacguggagcucauccgcggccggaagcaggagacccgcgugugguggaccuccaacagcaucgucguguucugcggcaccuccgggacguacggcaccgggagcuggcccgacggcgccaacaucaaccugaugcccaucuga

SEQ ID NO: 76788 - RNA, 1410 nt, Artificial Sequence
  derived and/or modified sequence opt1 from neuraminidase__InfluenzaA__ABO44071
augaaccccaaccagaagaucaucaccaucggcuucguguuccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugcaagaaccccaacaacgagcgggggaaccagggcgugaaggggugggccuucgacaacggcgacgacgucuggaugggccgcaccaucagcaaggaccugcgguccggguacgagaccuucaaggugaucggcggguggagcacccccaacuccaagagccagaucaaccgccaggucaucguggacuccgacaaccggagcggcuacuccgggaucuucagcguggagggcaaguccugcaucaaccgcugcuucuacgucgagcucauccgcggccggaagcaggagacccgcgugugguggaccagcaacagcaucguggucuucugcgggaccuccggcacguacgggaccggcagcuggccggacggggccaacaucaacuucaugcccaucuga

SEQ ID NO: 76789 - RNA, 1410 nt, Artificial Sequence; identical to SEQ ID NO: 75354
  derived and/or modified sequence opt1 from neuraminidase__InfluenzaA__ABO44082

SEQ ID NO: 76790 - RNA, 1410 nt, Artificial Sequence
  derived and/or modified sequence opt1 from neuraminidase__InfluenzaA__ABO44093
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugcuggacaucuccauggaggacuacagcaucgacuccagcuacgugugcuccgggcuggucggcgacacgccccggaacgacgacagcuccagcaacuccaacugccgcgaccccaacaacgagcgggggaacccgggcgugaaggggugggccuucgacaacggcgacgacguguggaugggccgcaccaucagcaaggaccuccgguccggguacgagaccuucaaggucaucggcggguggagcacccccaacuccaagagccaggugaaccgccaggucaucguggacaacaacaacugguccggcuacagcgggaucuucagcguggagggcaaguccugcaucaaccggugcuucuacgucgagcugauccgcggccgcagccaggagacccgggugugguggaccuccaacagcaucguggucuucugcgggaccuccggcacguacgggaccggcagcuggcccgacggggccaacaucaacuucaugcccaucuga

SEQ ID NO: 76791 - RNA, 1410 nt, Artificial Sequence
  derived and/or modified sequence opt1 from neuraminidase__InfluenzaA__ABO44104
augaaccccaaccagaagaucaucaccaucggcagcgccucccugaccaucgccacggugugcuuccucaugcagaucgcgauccuggucaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccaaggugguggaguaccggaacuggagcaagccgcagugcaagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgcguggagcuccagcuccugccacgacggcaaggccuggcugcacgugugcgugaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgcgagcgggcgggccgacacgcgcauccuguucaucgaggagggcaagaucgugcacaucagcccccucuccgggagcgcccagcacguggaggagugcuccugcuacccccgguacccggacguccgcugcaucugccgggacaacuggaagggcagcaaccgccccgugguggacaucaacauggaggacuacuccaucgacagcuccuacgucugcagcggccuggugggggacacgccccggaacgacgaccgcuccagcaacuccaacugccggaaccccaacaacgagaagggcaaccagggggugaagggcugggccuucgacaacggggacgacgucuggaugggccgcaccaucagcaaggaccugcgguccggcuacgagaccuucaaggugaucgggggcuggagcaccccgaacuccaagagccagaucaaccgccaggucaucguggacuccgacaaccggagcggguacuccggcaucuucagcguggagggcaagagcugcaucaaccgcugcuucuacgucgagcucauccgcggccggaagcaggagacccgcgugugguggaccuccaacagcaucguggucuucugcggcaccuccgggacguacggcaccgggagcuggcccgacggcgccaacaucaaccugaugcccaucuga

SEQ ID NO: 76792 - RNA, 1413 nt, Artificial Sequence
  derived and/or modified sequence opt1 from neuraminidase__InfluenzaA__ABO44126
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacgcagggggcccugcucaacgacaagcacagcaacggcaccgugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagacgaucaagagcuggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagagcaucgagcugaacgcccccaacucccacuacgaggagugcagcugcuaccccgacgccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagagcaacuccagccggcgcggcuucgagaugaucugggaccccaacggguggacggacaccgacuccaaguuccuggucaagcaggacgugguggccaucaccgacuggagcggcuacagcggcuccuucguccagcacccggagcugaccgggcucgacugcaugcggcccugcuucuggguggagcugauccgcggccggccccgcgagaacacgaccaucuggaccagcggguccagcaucuccuucugcggcgucaacggcgacaccgccaacuggagcuggcccgacggggccgagcugccguucacgaucgacaaguga

SEQ ID NO: 76793 - RNA, 1413 nt, Artificial Sequence
  derived and/or modified sequence opt1 from neuraminidase__InfluenzaA__ABO52228
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacuccaaguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcggauccuccgcacccaggagagcgagugcgucugcaugaacggcuccugcuucaccaucaugacggacgggcccagcaacggcgccgccuccuaccggaucuucaagaucgagaaggggcgcgugaccaagagcaucgagcuggacgccccgaacuaccacuacgaggagugcuccugcuaccccgacaccggcaccgugaugugcgucugccgggacaacuggcacgggagcaaccgccccuggguguccuucaaccagaaccuggacuaccagaucggcuacaucugcagcggcguguucggggacaacccccggccgaaggacggcgagggguccugcaaccccgucacgguggacggcgcggacggggugaagggcuucagcuaccgcuacggcaacggggucuggaucggccggaccaaguccaaccgccuccggaagggguucgagaugaucugggaccccaacggcuggaccgacaccgacagcgacuucuccaugaagcaggacaucguggccaugacggacuggagcggguacuccggcagcuucgugcagcaccccgagcugaccggccuggacugcaugcgcccgugcuucugggucgagcucgugcgggggcugccccgcgagaacaccaccaucuggacgagcggcuccagcaucuccuucugcggggugaacagcgacaccgccaacugguccuggcccgacggcgccgagcugcccuucaccaucgacaaguga

SEQ ID NO: 76794 - RNA, 1410 nt, Artificial Sequence
  derived and/or modified sequence opt1 from neuraminidase__InfluenzaA__ABO52239
augaaccccaaccagaagaucaucaccaucggcagcgugucccugaccaucgccacggucugcuucaucaugcagaucgccauccucgcgaccaccgugacccugcacuucaagcagcacgagugcgacagcccggccuccaaccaggugaugcccugcgagcccaucaucaucgagcgcaacaucacggagaucgucuaccugaacaacaccaccaucgagaaggagaucugccccgaggccguggaguaccggaacuggagcaagccgcagugccagaucaccggguucgcccccuucuccaaggacaacagcauccgccucuccgccggcggggacaucugggugacgcgggagcccuacgucagcugcgaccccggcaagugcuaccaguucgcgcuggggcagggcaccacccuggacaacaagcacuccaacggcaccauccacgaccgcaucccgcaccggacgcuccugaugaacgagcugggggugcccuuccaccucggcaccaagcaggucugcguggccuggagcuccagcuccugccacgacgggaaggccuggcugcacgugugcgugaccggcgacgacaagaacgccaccgcgagcuucaucuacgacgggcgccuggucgacuccaucggcagcuggucccagaacauccuccggacgcaggagagcgagugcgugugcaucaacgggaccugcaccguggucaugaccgacggcuccgccagcggccgcgccgacacgcggauccuguucaucaaggaggggaagaucgugcacaucagcccccuguccggcagcgcccagcacguggaggagugcuccugcuacccccgcuacccggacguccggugcaucugccgcgacaacuggaagggcagcaaccggcccgugaucgacaucaacauggaggacuacuccaucgacagcuccuacgugugcagcgggcucgucggcgacacgccccgcaacgacgacuccagcuccaacagcaacugccgggaccccaacaacgagcgcgggaacccgggcgugaaggggugggccuucgacaacggcgacgacguguggaugggccggaccaucaacaaggacucccgcagcggguacgagaccuucaaggucaucggcgggugguccacccccaacagcaagucccaggugaaccggcaggucaucguggacaacaacaacuggagcggcuacuccgggaucuucagcguggagggcaagagcugcaucaaccgcugcuucuacgucgagcugauccggggccgcccccaggagacccgcgugugguggaccuccaacagcaucguggucuucugcgggaccuccggcacguacgggaccggcagcuggcccgacggggcgaacaucaacuucaugccgaucuga

SEQ ID NO: 76795 - RNA, 1410 nt, Artificial Sequence; identical to SEQ ID NO: 76791
  derived and/or modified sequence opt1 from neuraminidase__InfluenzaA__ABO52250

SEQ ID NO: 76796 - RNA, 1413 nt, Artificial Sequence
  derived and/or modified sequence opt1 from neuraminidase__InfluenzaA__ABO52261
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacagcucccugugcccgauccggggcugggccaucuacagcaaggacaacuccauccgcaucgggagcaagggcgacguguucgucauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagagcgagugcgugugcgucaacggcuccugcuucaccaucaugacggacgggcccagcaacggcccggccuccuaccggaucuucaagaucgagaaggggaagaucaccaagagcaucgagcuggacgcccccaacucccacuacgaggagugcagcugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugacggucgacggcgccgacggggugaagggcuucuccuaccgguacggcaacgggguguggaucggccgcaccaagagcaacuccagccggaagggguucgagaugaucugggaccccgacggcuggaccgacaccgacuccaacuuccuggucaagcaggacgugguggccaugacggacuggagcggguacagcggcuccuucguccagcacccggagcugaccggccucgacugcauccgccccugcuucuggguggagcugauccgggggcgcccccgggagaagaccaccaucuggacgagcggcuccagcaucuccuucugcggggucaacagcgacaccgugaacugguccuggcccgacggcgcggagcugccguucaccaucgacaaguga

SEQ ID NO: 76797 - RNA, 1413 nt, Artificial Sequence
  derived and/or modified sequence opt1 from neuraminidase__InfluenzaA__ABO52283
augaaccccaaccagaagaucaucaccaucggcagcaucugcaugaccaucgggacgaucucccugauccuccagaucggcaacaucaucagcaucuggaucucccacagcauccagaccgggucccagaaccacaccggcaucugcaaccagcgcaucaucaccuacgagaacaacacgugggugaaccagaccuacgucaacaucagcaacaccaacgugguggccgggaaggacaccacguccaugauccuggccggcaacagcucccugugcccgauccggggcugggcgaucuacagcaaggacaacuccauccgcaucgggagcaagggcgacgucuucgugauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcgucgccuggagcgcguccgccugccacgacggcaugggcuggcugacgaucgggaucagcggccccgacgacggggccguggccgugcucaaguacaacggcaucaucaccgagaucaucaaguccuggcgcaagcagauccugcggacccaggagagcgagugcgucugcgugaacggcuccugcuucaccaucaugacggacgggcccagcgacggcccggcguccuaccgcaucuucaagaucgagaaggggaagaucaccaagagcaucgagcuggacgcccccaacucccacuacgaggagugcagcugcuaccccgacaccggcaaggugaugugcgucugccgggacaacuggcacggguccaaccgccccugggugagcuucaaccagaaccucgacuaccagaucggcuacaucugcuccggcguguucggggacaacccgcggcccaaggacggcaaggggagcugcgaccccgucaacguggacggcgccgacggggugaagggcuucuccuaccgcuacggcgacggggucuggaucggccggaccaagagcaacuccagccgcaagggguucgagaugaucugggaccccaacggcuggacggacaccgacgacaacuuccuggugaagcaggacguggucgccaugaccgacugguccggguacagcggcagcuucgugcagcacccggagcugaccggccucgacugcaugcggcccugcuucuggguggagcugauccgcgggcggccccgcgagaagacgaccaucuggaccuccggcagcuccaucagcuucugcggggucaacuccgacaccgugaacuggagcuggcccgacggcgccgagcugccguucacgaucgacauguga

SEQ ID NO: 76798 - RNA, 1410 nt, Artificial Sequence; identical to SEQ ID NO: 76526
  derived and/or modified sequence opt1 from neuraminidase__InfluenzaA__ABO52294

SEQ ID NO: 76799 - RNA, 1410 nt, Artificial Sequence
  derived and/or modified sequence opt1 from neuraminidase__InfluenzaA__ABO52316
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccagaucaugcccugcgagcccacgaucaucgagcgcaacaucaccgagaucguguaccucaccaacaucaccaucgagaaggagaucugccccaagcuggucgaguaccggaacugguccaagccgcagugcaagaucacgggguucgcccccuucagcaaggacaacuccauccgccugagcgccggcggggacaucugggugacccgggagcccuacguguccugcgaccccagccgcugcuaccaguucgcccucggccaggggaccacccuggacaacaagcacuccaacgacacgauccacgaccggaccccgcaccgcacccugcucaugaacgagcugggcguccccuuccaccugggcacccgccaggugugcaucgccuggagcuccagcuccugccacgacgggaaggcguggcuccacgugugcgucacgggcuacgacaagaacgccaccgccagcuucaucuacgacgggcggcugguggacuccaucggcagcuggucccagaacauccugcggacccaggagagcgagugcgugugcaucaacgggaccugcacggucgugaugaccgacggcuccgccagcggccgcgcggacaccaagauccucuucaucgaggaggggaagaucgugcacaucagcccccuguccggcagcgcccagcacgucgaggagugcuccugcuacccccgguacccgggggugcgcugcaucugccgggacaacuggaagggcagcaaccgccccguggucgacaucaacgugaaggacuacuccaucgacagcuccuacgugugcagcggccuggucggggacacgccccggaagaacgaccgcuccagcaacuccuacugccggaaccccaacaacgagaagggcaaccacggggugaagggcugggccuucgacgacgggaacgacguguggaugggccgcaccaucagcgaggacucccggagcggcuacgagaccuucaaggucaucgggggcugguccaccccgaacagcaagcuccagaucaaccgccaggugaucgucgacuccgacaaccggagcggguacuccggcaucuucagcguggagggcaagagcugcaucaaccgcugcuucuacguggagcugauccgcgggcgggagcaggagacccgcgucugguggacguccaacagcaucgugguguucugcggcaccuccgggaccuacggcgccgggagcuggcccgacggcgccgacaucaaccugaugcccaucuga

SEQ ID NO: 76800 - RNA, 1410 nt, Artificial Sequence; identical to SEQ ID NO: 75122
  derived and/or modified sequence opt1 from neuraminidase__InfluenzaA__ABO52327

SEQ ID NO: 76801 - RNA, 1410 nt, Artificial Sequence
  derived and/or modified sequence opt1 from neuraminidase__InfluenzaA__ABO52338
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagcaagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggaaccacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgacaaccgcagcggcuacuccgggaucuucagcguggagggcaagagcugcaucaaccggugcuucuacgucgagcugauccgcggccgcgagcaggagacccgggugugguggacguccaacagcaucguggucuucugcgggaccuccggcaccuacgggaccggcagcuggcccgacggggccgacaucaaccugaugcccaucuga

SEQ ID NO: 76802 - RNA, 1410 nt, Artificial Sequence
  derived and/or modified sequence opt1 from neuraminidase__InfluenzaA__ABO52349
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacgucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaccccguaccggacccugcucaugaacgagcugggcgugcccuuccaccuggggacccgccaggucugcaucgccugguccagcuccagcugccacgacggcaaggcguggcuccacgugugcgugacgggguacgacaagaacgccaccgccuccuucaucuacgacggccggcuggucgacagcaucggguccuggagcaagaacauccugcgcacccaggaguccgagugcgugugcaucaacgggaccugcacgguggucaugaccgacggcagcgccuccgagcgggcggacaccaagauccucuucaucgaggaggggaagaucauccacaucagcccccugagcggcuccgcccagcacguggaggagugcagcugcuacccccgcuacccgggggugcggugcaucugccgcgacaacuggaagggcuccaaccggcccgucguggacaucaacaugcgcgacuacagcaucguguccagcuacgucugcuccggccuggugggggacacgccccggaagaacgaccgcagcuccagcuccuacugccggaaccccaacaacgagaagggcaaccacggggugaagggcugggccuucgacgacgggaacgacgucuggaugggccgcaccaucagcgaggagucccggagcggcuacgagaccuucaaggugaucgggggcugguccaccccgaacagcaagcuccagaucaaccgccaggucaucguggacuccaacaaccggagcggguacuccggcaucuucagcguggagggcaagagcugcaucaaccgcugcuucuacgucgagcugauccgcggccgggagcaggagacccgcgugugguggacguccaacagcaucguggucuucugcggcaccuccgggaccuacggcaccgggagcuggcccgacggcgccgacaucaaccugaugcccaucuga

SEQ ID NO: 76803 - RNA, 1410 nt, Artificial Sequence
  derived and/or modified sequence opt1 from neuraminidase__InfluenzaA__ABO52360
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcaacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 76804 - RNA, 1410 nt, Artificial Sequence
  derived and/or modified sequence opt1 from neuraminidase__InfluenzaA__ABO52371
augaaccccaaccagaagaucaucaccaucggcagcgugucccugaccaucgccacggucugcuuccucaugcagaucgccauccuggugaccaccgugacccugcacuuccgccaguacgagugcgacagcccggcgaacaaccaggucaugcccugcgagcccaucaucaucgagcggaacaucacggagaucguguaccucaacaacaccaccaucgagaaggagaucugccccaagcugguggaguaccgcaacugguccaagccgcagugcaagaucaccggguucgcccccuucagcaaggacaacuccauccggcugagcgccggcggggacaucugggucacgcgcgagcccuacguguccugcgaccccggcaagugcuaccaguucgcccucgggcagggcaccacccuggacaacaagcacagcaacgacaccauccacgaccggaucccgcaccgcacgcugcucaugaacgagcugggcgugcccuuccaccuggggacccggcaggucugcaucgccugguccagcuccagcugccacgacggcaaggcguggcuccacgugugcgugaccggggacgacaagaacgccaccgccuccuucaucuacgacggcaagcuggucgacagcaucggguccuggagccagaacauccugcgcacgcaggaguccgagugcgugugcaucaacgggaccugcaccguggucaugaccgacggcagcgccuccggccgggcggacacgcgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucgaggacuacagcaucgacuccagcuacgugugcuccgggcuggugggcgacacgccccggaacaacgaccgcagcgggaacuccaacugccggaaccccaacaacgagcgcggcaaccacggggucaagggcugggccuucgacgacggcaacgacguguggauggggcggaccaucaacaaggaccuccgcagcggcuacgagaccuucaaggucaucgggggcugguccaccccgaacagcaagucccagaucaaccgccaggugaucguggacagcgacaaccgguccggguacagcggcaucuucuccgucgagggcaagagcugcaucaaccgcugcuucuacguggagcugauccgggggcgcgagcaggagacccgggugugguggaccuccaacagcaucgucguguucugcggcaccagcgggacguacggcaccggguccuggcccgacggcgccgacaucaaccugaugcccaucuga

SEQ ID NO: 76805 - RNA, 1413 nt, Artificial Sequence
  derived and/or modified sequence opt1 from neuraminidase__InfluenzaA__ABO52800
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccagcaacggcccggcguccuaccggaucuucaagaucgagaaggggaagaucaccaagagcaucgagcuggacgcccccaacucccacuacgaggagugcagcugcuaccccgacaccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggaccgacacggacuccaacuuccuggucaagcaggacgugguggccaugaccgacuggagcggguacagcggcuccuucguccagcacccggagcugaccggccucgacugcaugcgccccugcuucuggguggagcugauccgggggcgcccccgggagcgcaccacgaucuggaccagcggcuccagcaucuccuucugcggggucaacagcgacaccgccaacugguccuggcccgacggcgcggagcugccguucaccaucgacaaguga

SEQ ID NO: 76806 - RNA, 1413 nt, Artificial Sequence; identical to SEQ ID NO: 75836
  derived and/or modified sequence opt1 from neuraminidase__InfluenzaA__ABP49220

SEQ ID NO: 76807 - RNA, 1413 nt, Artificial Sequence
  derived and/or modified sequence opt1 from neuraminidase__InfluenzaA__ABP49319
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacaacaccugggucaaccagaccuacgugaacaucagcaacacgaacguggucgccgggaaggacaccaccuccaugauccuggcgggcaacagcucccugugcccgauccggggcugggccaucuacagcaaggacaacuccauccgcaucgggagcaagggcgacguguucgugauccgggagcccuucaucuccugcagccaccucgagugccgcaccuucuuccugacgcagggggcccugcucaacgacaagcacuccaacggcaccgucaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccguggcgguccucaaguacaacggcaucaucaccgagacgaucaaguccuggcgcaagcagauccugcggacccaggagagcgagugcgugugcgugaacggcuccugcuucaccaucaugaccgacgggcccagcgacggcccggccuccuaccgcaucuucaagaucgagaaggggaagaucaccaagagcaucgagcuggacgcccccaacucccacuacgaggagugcagcugcuaccccgacacgggcaaggucaugugcgugugccgggacaacuggcacggguccaaccgccccugggugagcuucaaccagaaccucgacuaccagaucggcuacaucugcuccggcgucuucggggacaacccgcggcccaaggacggcaaggggagcugcgaccccgugaacguggacggcgccgacggggucaagggcuucuccuaccgcuacggcaacgggguguggaucggccggaccaagagcaacuccagccgcaagggguucgagaugaucugggaccccaacggcuggaccgacacggacgggaacuuccuggugaagcaggacgucguggccaugaccgacugguccggcuacagcggcagcuucgugcagcacccggagcugaccgggcucgacugcaugcggcccugcuucugggucgagcugauccgcggccggccccgcgagaagaccacgaucuggaccuccgggagcuccaucagcuucugcggcgugaacuccgacaccgucaacuggagcuggcccgacggcgcggagcugccguucaccaucgacaaguga

SEQ ID NO: 76808 - RNA, 1410 nt, Artificial Sequence
  derived and/or modified sequence opt1 from neuraminidase__InfluenzaA__ABP49330
augaaccccaaccagaagaucaucaccaucggcagcaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucagcaacacgaacgucguggccgggaagggcaccaccccggugauccuggccggcaacuccagccugugccccauccgcgggugggcgaucuacuccaaggacaacggcauccggaucgggagcaagggcgacgucuucgugauccgcgagcccuucaucuccugcagccaccucgagugccggaccuucuuccugacgcagggggcccugcucaacgacaagcacuccaacggcaccgugaaggaccgcagccccuaccgggcccugauguccugcccggucggcgaggcccccagccccuacaacucccgcuucgagagcguggccuggagcgcgugcgccugccacgacgggaugggcuggcugaccaucgggaucuccggccccgacgacgaggccguggccguccucaaguacaacggcaucaucaccgagacgaucaagagcuggcggaagaagauccugcgcacccaggaguccgagugcgugugcgugaacgggagcugcuucaccaucaugaccgacggcccguccgacgggcccgcgagcuacaagaucuucaagaucgagaagggcaaggucacgaaguccaucgagcuggacgcccccaacagccacuacgaggagugcuccugcuaccccgacaccgggaaggugaugugcgugugccgggacaacuggcacggcagcaaccgcccgugggucuccuucgaccagaaccucgacuaccagaucggcuacaucugcagcgggguguucggcgacaacccccggcccaaggacgggaagggcuccugcgggcccguguacgucgacggcgccaacggcgugaagggguucagcuaccgcuacggcaacgggguguggaucggccggaucaaguccaacagcucccgccagggguucgagaugaucugggacccgaacggcuggaccgagaccgacagcuccuucuucgucaagcaggacguggucgccaugacggacuggagcggcuacagcggguccuucgugcagcaccccgagcugaccggccuggacugcaugcggcccugcuucuggguggagcucauccgcgggcggcccaaggagaagaccaucuggaccagcggcuccagcaucuccuucugcggcgucaacagcgacacgguggacugguccuggccggacggggccgagcugcccuucaccaucgacaaguga

SEQ ID NO: 76809 - RNA, 1413 nt, Artificial Sequence
  derived and/or modified sequence opt1 from neuraminidase__InfluenzaA__ABP49352
augaaccccaaccagaagaucaucaccaucggcagcaucugcaugaccaucgggaucaucucccugauccuccagaucggcaacaucaucagcaucugggugucccacagcauccagacggggucccagaaccacaccggcaucugcaaccagcgcaucaucaccuacgagaacagcaccugggucaaccagacguacgugaacaucaacaacaccaacguggucgccgggaaggacaccaccuccguggcccuggcgggcaacagcucccugugcccgauccggggcugggccaucuacagcaaggacaacuccauccgcaucgggagcaagggcgacguguucgucauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagagcgagugcgugugcgucaacggcuccugcuucaccaucaugacggacgggcccagcgacggcccggccuccuaccggaucuucaagaucgagaaggggaagaucaccaagagcaucgagcuggacgcccccaacucccacuacgaggagugcagcugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugacggucgacggggccgacggcgugaagggcuucuccuacaaguacgggaacggcguguggaucgggcggaccaagagcaacuccagccgcaagggcuucgagaugaucugggaccccaacggguggaccgacaccgacuccaacuuccuggucaagcaggacgugguggccaugacggacuggagcggcuacagcggcuccuucguccagcacccggagcugaccgggcucgacugcaugcggcccugcuucuggguggagcugauccgcggccggccccgcgagcggaccaccaucuggacgagcggguccagcaucuccuucugcggcgucgacagcgacaccgcgaacugguccuggcccgacggcgccgagcugccguucaccaucgacaaguga

SEQ ID NO: 76810 - RNA, 1413 nt, Artificial Sequence; identical to SEQ ID NO: 76706
  derived and/or modified sequence opt1 from neuraminidase__InfluenzaA__ABP49363

SEQ ID NO: 76811 - RNA, 1410 nt, Artificial Sequence; identical to SEQ ID NO: 75738
  derived and/or modified sequence opt1 from neuraminidase__InfluenzaA__ABP49374

SEQ ID NO: 76812 - RNA, 1413 nt, Artificial Sequence
  derived and/or modified sequence opt1 from neuraminidase__InfluenzaA__ABP49385
augaaccccaaccagaagaucaucaccaucggcagcaucuccguggccaucgggaucaucaaccugacccuccagaucggcaacaucaucagcaucugggccucccacagcauccagacggggucccagaacuacaccggcaucugcaaccagcgcaucaucaccuacgagaaccggaccugggucaaccagacguacgugaacaucaacaacaccaacguggucgcggggaaggacaagaccagcaugacccuggccggcaacuccagccugugcccgauccgcggcugggccaucuacacgaaggacaacuccauccggaucgggagcaagggcgacguguucgugauccgcgagcccuucaucuccugcagccaccucgagugccggaccuucuuccugacccagggggcccugcucaacgacaagcacuccaacggcaccaucaaggaccgcagccccuuccgggcccugauguccugcccccugggggaggcgccgagccccuacaacucccgcuucgagagcgucgccugguccgccagcgccugccacgacggccucggcuggcugacgaucgggaucagcggccccgacaacggggcgguggccgugcugaaguacaacggcaucaucaccgagaccaucaaguccuggaagaagcagauccuccggacccaggagagcgagugcgucugcgugaacggcuccugcuucacgaucaugaccgacgggcccagcaaccgcgccgccuccuaccggaucuucaagaucgagaagggccgcgugaccaagagcaucgagcuggacgccccgaacuaccacuacgaggagugcuccugcuaccccgacaccgggacggucaugugcgugugccgggacaacuggcacggcagcaaccgccccuggguguccuucaaccagaaccuggacuaccagaucggguacaucugcagcggcgucuucggcgacaacccccggccgaaggacggggagggcuccugcaaccccgugaccguggacggggcggacggcgucaagggguucagcuaccgcuacggcaacggcguguggaucgggcggaccaaguccaaccgccuccggaagggcuucgagaugaucugggaccccaacggguggaccgacacggacagcgacuucuccaugaagcaggacguggucgccaugaccgacuggagcggcuacuccgggagcuucgugcagcaccccgagcugaccggccuggacugcaugcgcccgugcuucuggguggagcucguccggggccugccccgcgagaacaccacgaucuggaccuccgggagcagcaucuccuucugcggcgugaacagcgagaccgccaacugguccuggcccgacggggccgagcugcccuucaccaucgacaaguga

SEQ ID NO: 76813 - RNA, 1413 nt, Artificial Sequence; identical to SEQ ID NO: 75394
  derived and/or modified sequence opt1 from neuraminidase__InfluenzaA__ABP49396

SEQ ID NO: 76814 - RNA, 1410 nt, Artificial Sequence
  derived and/or modified sequence opt1 from neuraminidase__InfluenzaA__ABP49407
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugagcgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucagcgucgaggggaagaucugcaucaaccgcugcuucuacguggagcucauccggggccgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76815 - RNA, 1410 nt, Artificial Sequence; identical to SEQ ID NO: 75738
  derived and/or modified sequence opt1 from neuraminidase__InfluenzaA__ABP49418

SEQ ID NO: 76816 - RNA, 1410 nt, Artificial Sequence; identical to SEQ ID NO: 75738
  derived and/or modified sequence opt1 from neuraminidase__InfluenzaA__ABP49429

SEQ ID NO: 76817 - RNA, 1410 nt, Artificial Sequence
  derived and/or modified sequence opt1 from neuraminidase__InfluenzaA__ABP49440
augaaccccaaccagaagaucaucaccaucggcagcgugucccugaccaucgccacggucugcuuccucauccagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggacagccgguccggguacgagaccuucaaggucaucggcggguggagcacccccaacuccaagagccaggccaaccgccaggugaucgucgacaagaacaacugguccggcuacagcgggaucuucagcguggagggcaaguccugcaucaaccggugcuucuacguggagcugauccgcggccgcccccaggagacccgggucugguggaccagcaacuccaucgugguguucugcgggaccagcggcacguacgggaccggcuccuggcccgacggggcgaacaucaacuucaugccgaucuga

SEQ ID NO: 76818 - RNA, 1413 nt, Artificial Sequence; identical to SEQ ID NO: 75959
  derived and/or modified sequence opt1 from neuraminidase__InfluenzaA__ABP49451

SEQ ID NO: 76819 - RNA, 1410 nt, Artificial Sequence
  derived and/or modified sequence opt1 from neuraminidase__InfluenzaA__ABP49462
augaaccccaaccagaagaucaucaccaucggcagcgugucccugaccaucgccacggucugcuucaucaugcagaucgccauccucgcgaccaccgugacccugcacuucaagcagcacgagugcgacagcccggccuccaaccaggugaugcccugcgagcccaucaucaucgagcgcaacaucacggagaucgucuaccugaacaacaccaccaucgagaaggagaucugccccgaggccguggaguaccggaacuggagcaagccgcagugccagaucaccggguucgcccccuucuccaaggacaacagcauccgccucuccgccggcggggacaucugggugacgcgggagcccuacgucagcugcgaccccggcaagugcuaccaguucgcgcuggggcagggcaccacccuggacaacaagcacuccaacggcaccauccacgaccgcaucccgcaccggacgcuccugaugaacgagcugggggugcccuuccaccucggcaccaagcaggucugcguggccuggagcuccagcuccugccacgacgggaaggccuggcugcacgugugcgugaccggcgacgaccgcaacgccaccgcgagcuucaucuacgacgggcggcuggucgacuccaucggcagcuggucccagaacauccuccgcacgcaggagagcgagugcgugugcaucaacgggaccugcaccguggucaugaccgacggcuccgccagcggccgggccgacacgcgcauccuguucaucaaggaggggaagaucgugcacaucagcccccuguccggcagcgcccagcacaucgaggagugcuccugcuacccccgguacccggacgugcgcugcaucugccgggacaacuggaagggcagcaaccgccccgucaucgacaucaacauggaggacuacuccaucgacagcuccuacgugugcagcgggcucgugggcgacacgccccggaacgacgacuccagcuccaacagcaacugccgcgaccccaacaacgagcgggggaacccgggcgucaaggggugggccuucgacaacggcgacgacguguggaugggccgcaccaucaacaaggacucccggagcggguacgagaccuucaaggugaucggcgggugguccacccccaacagcaagucccaggucaaccgccaggugaucgucgacaacaacaacuggagcggcuacuccgggaucuucagcguggagggcaagagcugcaucaaccggugcuucuacguggagcugauccgcggccgcccccaggagacccgggucugguggaccuccaacagcaucgugguguucugcgggaccuccggcacguacgggaccggcagcuggcccgacggggcgaacaucaacuucaugccgaucuga

SEQ ID NO: 76820 - RNA, 1410 nt, Artificial Sequence; identical to SEQ ID NO: 76768
  derived and/or modified sequence opt1 from neuraminidase__InfluenzaA__ABP49473

SEQ ID NO: 76821 - RNA, 1410 nt, Artificial Sequence
  derived and/or modified sequence opt1 from neuraminidase__InfluenzaA__ABP49495
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcccccugagcggguccgcccagcacguggaggagugcagcugcuacccccgcuacccgggcgugcggugcaucugccgcgacaacuggcggggcuccaaccgccccgucguggacaucaacgugaaggacuacagcaucgacuccagcuacgucugcuccgggcuggugggcgacacgccccggaacaacgaccgcagcuccagcuccuacugccggaaccccaacaacgagaaggggacccacggcgugaaggggugggccuucgacgacggcaacgacgucuggaugggccgcaccaucagcgaggacucccggagcggguacgagaccuucaaggugaucggcgggugguccacgccgaacagcaagcuccagaucaaccgccaggucaucguggacuccgacaaccggagcggcuacuccgggaucuucagcguggagggcaagagcugcaucaaccgcugcuucuacgucgagcugauccgcggccgggagcaggagacccgcgugugguggaccuccaacagcaucguggucuucugcgggaccuccggcacguacgggaccggcagcuggcccgacggggccgacaucaaccugaugcccaucuga

SEQ ID NO: 76822 - RNA, 1410 nt, Artificial Sequence; identical to SEQ ID NO: 75111
  derived and/or modified sequence opt1 from neuraminidase__InfluenzaA__ABP49506

SEQ ID NO: 76823 - RNA, 1410 nt, Artificial Sequence; identical to SEQ ID NO: 75103
  derived and/or modified sequence opt1 from neuraminidase__InfluenzaA__ABP49517

SEQ ID NO: 76824 - RNA, 1413 nt, Artificial Sequence
  derived and/or modified sequence opt1 from neuraminidase__InfluenzaA__ABQ01314
augaaccccaaccagaagaucaucaccaucggcagcaucugcauggccaucgggaccaucucccugauccuccagaucggcaacaucaucagcaucugggugucccacagcauccagacggggucccagaaccacaccggcaucugcaaccagcgcaucaucaccuacgagaacaacaccugggucaaccagacguacgugaacaucagcaacaccaacguggucgccgggaaggacaccaccuccaugauccuggcgggcaacagcucccugugcccgauccggggcugggccaucuacagcaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccguggcgguccucaaguacaacggcaucaucacggagaucaucaaguccuggcgcaagcagauccugcggacccaggagagcgagugcgugugcgugaacggcuccugcuucaccaucaugaccgacgggcccagcgacggcccggccuccuaccgcaucuucaagaucgagaaggggaagaucaccaagagcaucgagcuggacgcccccaacucccacuacgaggagugcagcugcuaccccgacacgggcaaggucaugugcgugugccgggacaacuggcacggguccaaccgccccugggugagcuucaaccagaaccucgacuaccagaucggcuacaucugcuccggcgucuucggggacaacccgcggcccaaggacggcaaggggagcugcgaccccgugaacguggacggcgccgacggggucaagggcuucuccuaccgcuacggcaacgggguguggaucggccggaccaagagcaacuccagccgcaagggguucgagaugaucugggaccccaacggcuggaccgacacggacgggaacuuccuggugaagcaggacgucguggccaugaccgacugguccggcuacagcggcagcuucgugcagcacccggagcugaccgggcucgacugcaugcggcccugcuucugggucgagcugauccgcggccggccccgcgagaagaccacgaucuggaccuccgggagcuccaucagcuucugcggcgugaacuccgacaccgucaacuggagcuggcccgacggcgcggagcugccguucaccaucgacaaguga

SEQ ID NO: 76825 - RNA, 1413 nt, Artificial Sequence
  derived and/or modified sequence opt1 from neuraminidase__InfluenzaA__ABQ01325
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcagcugcuucaccaucaugacggacgggcccuccgacggccaggccagcuaccgcaucuucaagaucgagaaggggaagaucaccaaguccaucgagcuggacgccccgaacagccacuacgaggagugcuccugcuaccccgacaccggcaccgucaugugcgugugccgggacaacuggcacgggagcaaccgccccuggguguccuucaaccagaaccucgacuaccagaucggcuacaucugcagcggcgucuucggggacaacccccggccgaaggacggcaagggguccugcgaccccgugaacguggacggcgccgacggggucaagggcuucagcuaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggagcggguacuccggcagcuucgugcagcaccccgagcugacgggccucgacugcaugcggccgugcuucugggucgagcugauccgcgggcggccccgcgagaagaccaccaucuggaccuccggcagcuccaucagcuucugcggggugaacuccgacacggucaacuggagcuggcccgacggcgcggagcugcccuucaccaucgacaaguga

SEQ ID NO: 76826 - RNA, 1410 nt, Artificial Sequence; identical to SEQ ID NO: 75738
  derived and/or modified sequence opt1 from neuraminidase__InfluenzaA__ABQ01336

SEQ ID NO: 76827 - RNA, 1410 nt, Artificial Sequence; identical to SEQ ID NO: 75738
  derived and/or modified sequence opt1 from neuraminidase__InfluenzaA__ABQ01347

SEQ ID NO: 76828 - RNA, 1410 nt, Artificial Sequence
  derived and/or modified sequence opt1 from neuraminidase__InfluenzaA__ABQ01358
augaaccccaaccagaagaucaucaccaucggcagcgugucccugaccaucgccacggucugcuuccucaugcagaucgccauccuggcgaccaccgugacccugcacuucaagcagcacgagugcaacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucgaggacuccaucggcagcuggucccagaacauccugcgcacgcaggagagcgagugcgugugcaucaacgggaccugcaccguggucaugaccgacggcaacgcguccggccgggccgacacgcgcauccuguucaucaaggaggggaagaucgugcacaucagcccccucagcggcuccgcccagcacaucgaggagugcagcugcuacccccgguacccggacgugcgcugcaucugccgggacaacuggaagggcuccaaccgccccguccuggacaucagcauggaggacuacuccaucgacagcuccuacgugugcagcgggcuggugggcgacacgccccggaacgacgacuccagcuccaacagcaacugccgcgaccccaacaacgagcgggggaacccgggcgucaaggggugggccuucgacaacggcgacgacguguggaugggccgcaccaucuccaaggaccuccggagcggguacgagaccuucaaggugaucggcgggugguccacccccaacagcaagucccaggucaaccgccaggugaucgucgacaacaacaacuggagcggcuacuccgggaucuucagcguggagggcaagagcugcaucaaccggugcuucuacguggagcugauccgcggccgcucccaggagacccgggucugguggaccagcaacuccaucgugguguucugcgggaccagcggcacguacgggaccggcuccuggcccgacggggccaacaucaacuucaugcccaucuga

SEQ ID NO: 76829 - RNA, 1410 nt, Artificial Sequence
  derived and/or modified sequence opt1 from neuraminidase__InfluenzaA__ABQ01369
augaaccccaaccagaagaucaucaccaucggcagcgugucccugaccaucgccacgaucugcuucgucaugcagaucgccauccucgugaccaccgugacccugcacuucaagcaguacgagugcgacagcccggcgaacaaccaggucaugcccugcgagcccaucaucaucgagcgcaacaucacggagaucguguaccugaccaacaccaccaucgagaaggagaucugccccaagcucguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccuggggcagggcaccacccucgacaacaagcacagcaacgacacgauccacgaccgcaccccgcaccggacccugcugaugaacgagcucggcgugcccuuccaccuggggacccgccaggucugcaucgccugguccagcuccagcugccacgacggcaaggcguggcugcacgugugcgugacgggguacgacaagaacgccaccgccuccuucaucuacgacggccggcucgucgacagcaucggguccuggagccagaacauccugcgcacccaggaguccgagugcgugugcaucaacgggaccugcacgguggucaugaccgacggcagcgccuccggccgggcggacaccaagauccuguucaucgaggagggcaagaucgugcacaccagcccccucagcggguccgcccagcacguggaggagugcagcugcuacccccgcuacccgggcguccggugcaucugccgcgacaacuggaagggcuccaaccggcccgugguggacaucaacgucaaggacuacagcaucgacuccagcuacgugugcuccgggcuggugggcgacacgccccgcaagaacgaccggagcuccagcuccuacugccgcaaccccaacaacgagaaggggacccacggcgucaaggggugggccuucgacgacggcaacgacguguggaugggccggaccaucagcgaggacucccgcagcggguacgagaccuucaaggucaucggcgggugguccacgccgaacagcaagcugcagaucaaccgccaggugaucguggacuccgacaaccggagcggcuacuccgggaucuucagcgucgagggcaagagcugcaucaaccggugcuucuacguggagcucauccgcggccgcgagcaggagacccgggugugguggaccuccaacagcaucgucguguucugcgggaccuccggcacguacgggaccggcagcuggcccgacggggccgacaucaaccugaugcccaucuga

SEQ ID NO: 76830 - RNA, 1410 nt, Artificial Sequence
  derived and/or modified sequence opt1 from neuraminidase__InfluenzaA__ABQ44386
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaacgaggugcuguggaccagcaacuccaucgucguguucugcgggaccagcggcaccuacgggaccggcuccuggccggacggggccgacaucaaccucaugcccaucuga

SEQ ID NO: 76831 - RNA, 1410 nt, Artificial Sequence; identical to SEQ ID NO: 75722
  derived and/or modified sequence opt1 from neuraminidase__InfluenzaA__ABQ44408

SEQ ID NO: 76832 - RNA, 1413 nt, Artificial Sequence
  derived and/or modified sequence opt1 from neuraminidase__InfluenzaA__ABQ44419
augaaccccaaccagaagaucaucaccaucggcagcaucugcauggccaucgggaucaucucccugauccuccagaucggcaacaucgugagcaucuggaucucccacagcauccagaacgggucccagaacuacaccggcaucugcaaccagcgcaucaucacguacgagaacagcaccugggucaaccagaccuacgugaacaucaacaacaccaacguggucgccgggcaggacacgaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacccagggggcccugcucaacgacaagcacagcaacggcacggugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagaccaucaagagcuggcggaagcgcauccugcggacgcaggaguccgagugcgugugcgucaacggcagcugcuucaccaucaugaccgacgggcccaacaacggcccggccuccuacaagaucuucaagaucgagaaggggaagaucaccaagagcaucgagcuggacgcccccaacucccacuacgaggagugcagcugcuaccccgacgccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagagcaacuccagccggcgcggcuucgagaugaucugggaccccaacggguggaccgacacggacuccaaguuccuggucaagcaggacgugguggccaugaccgacuggagcggcuacagcggcuccuucguccagcacccggagcugaccgggcucgacugcaugcggcccugcuucuggguggagcugauccgcggccggccccgcgagaacaccacgaucuggaccagcggguccagcaucuccuucugcggcgucaacggcgacaccgccaacuggagcuggcccgacggggccgagcugccguucaccaucgacaaguga

SEQ ID NO: 76833 - RNA, 1410 nt, Artificial Sequence; identical to SEQ ID NO: 75354
  derived and/or modified sequence opt1 from neuraminidase__InfluenzaA__ABQ44430

SEQ ID NO: 76834 - RNA, 1410 nt, Artificial Sequence; identical to SEQ ID NO: 76784
  derived and/or modified sequence opt1 from neuraminidase__InfluenzaA__ABQ44441

SEQ ID NO: 76835 - RNA, 1410 nt, Artificial Sequence; identical to SEQ ID NO: 76768
  derived and/or modified sequence opt1 from neuraminidase__InfluenzaA__ABQ44463

SEQ ID NO: 76836 - RNA, 1413 nt, Artificial Sequence
  derived and/or modified sequence opt1 from neuraminidase__InfluenzaA__ABQ44474
augaaccccaaccagaagaucaucaccaucggcagcaucugcaugaccaucgggacgaucucccugauccuccagaucggcaacaucaucagcaucugggugucccacagcauccagaccgggucccagaaccacaccggcaucugcaaccagcgcaucaucaccuacgagaacaacacgugggucaaccagaccuacgugaacaucagcaacaccaacguggucgccgggaaggacaccacguccaugauccuggccggcaacagcucccugugcccgauccggggcugggcgaucuacagcaaggacaacuccauccgcaucgggagcaagggcgacguguucgugauccgggagcccuucaucuccugcagccaccucgagugccgcaccuucuuccugacccagggggcccugcucaacgacaagcacuccaacggcaccgucaaggaccggagccccuaccgcgcccugauguccugccccaucggggaggccccgagccccuacaacucccgguucgagagcguggccuggagcgcguccgccugccacgacggcaugggcuggcugacgaucgggaucagcggccccgacgacggggccguggccguccucaaguacaacggcaucaucaccgagaucaucaaguccuggcgcaagcagauccugcggacccaggagagcgagugcgugugcgugaacggcuccugcuucaccaucaugacggacgggcccagcgacggcccggcguccuaccgcaucuucaagaucgagaaggggaagaucaccaagagcaucgagcuggacgcccccaacucccacuacgaggagugcagcugcuaccccgacaccggcaaggucaugugcgugugccgggacaacuggcacggguccaaccgccccugggugagcuucaaccagaaccucgacuaccagaucggcuacaucugcuccggcgucuucggggacaacccgcggcccaaggacggcaaggggagcugcgaccccgugaacguggacggcgccgacggggucaagggcuucuccuaccgcuacggcaacgggguguggaucggccggaccaagagcaacuccagccgcaagggguucgagaugaucugggaccccaacggcuggacggacaccgacgggaacuuccuggugaagcaggacgucguggccaugaccgacugguccggcuacagcggcagcuucgugcagcacccggagcugaccgggcucgacugcaugcggcccugcuucugggucgagcugauccgcggccggccccgcgagaagacgaccaucuggaccuccgggagcuccaucagcuucugcggcgugaacuccgacaccgucaacuggagcuggcccgacggcgccgagcugccguucacgaucgacaaguga

SEQ ID NO: 76837 - RNA, 1410 nt, Artificial Sequence; identical to SEQ ID NO: 75103
  derived and/or modified sequence opt1 from neuraminidase__InfluenzaA__ABR15800

SEQ ID NO: 76838 - RNA, 1413 nt, Artificial Sequence; identical to SEQ ID NO: 76824
  derived and/or modified sequence opt1 from neuraminidase__InfluenzaA__ABR15811

SEQ ID NO: 76839 - RNA, 1413 nt, Artificial Sequence; identical to SEQ ID NO: 75836
  derived and/or modified sequence opt1 from neuraminidase__InfluenzaA__ABR15910

SEQ ID NO: 76840 - RNA, 1410 nt, Artificial Sequence; identical to SEQ ID NO: 75162
  derived and/or modified sequence opt1 from neuraminidase__InfluenzaA__ABR15932

SEQ ID NO: 76841 - RNA, 1410 nt, Artificial Sequence
  derived and/or modified sequence opt1 from neuraminidase__InfluenzaA__ABR15943
augaaccccaaccagaagaucaucaccaucggcagcgugucccugaccaucgccacgaucugcuuccucaugcagaucgccauccuggucaccaccgugacccugcacuuccgccaguacgagugcaacagcccgcccaacaaccaggugaugcucugcgagcccacgaucaucgagcggaacaucaccgagaucgucuaccugaccaacaccacgaucgagaaggagaucugccccaagcuggcggaguaccgcaacugguccaagccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggacguacggcaccgggagcuggccggacggcgccgacaucaaccugaugcccaucuga

SEQ ID NO: 76842 - RNA, 1410 nt, Artificial Sequence
  derived and/or modified sequence opt1 from neuraminidase__InfluenzaA__ABR15954
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacaacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76843 - RNA, 1410 nt, Artificial Sequence; identical to SEQ ID NO: 75162
  derived and/or modified sequence opt1 from neuraminidase__InfluenzaA__ABR15965

SEQ ID NO: 76844 - RNA, 1410 nt, Artificial Sequence
  derived and/or modified sequence opt1 from neuraminidase__InfluenzaA__ABR22243
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaccgacagcuccagcuccagccacugccuggaccccaacaacgaggagggcgggcacggggucaagggcugggccuucgacgacggcaacgacguguggauggggcggaccaucuccgagaagucccgcagcggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggacguacggcaccgggagcuggcccgacggcgccgaccugaaccucaugcccaucuga

SEQ ID NO: 76845 - RNA, 1410 nt, Artificial Sequence; identical to SEQ ID NO: 75738
  derived and/or modified sequence opt1 from neuraminidase__InfluenzaA__ABR28518

SEQ ID NO: 76846 - RNA, 1410 nt, Artificial Sequence; identical to SEQ ID NO: 75584
  derived and/or modified sequence opt1 from neuraminidase__InfluenzaA__ABR28595

SEQ ID NO: 76847 - RNA, 1413 nt, Artificial Sequence
  derived and/or modified sequence opt1 from neuraminidase__InfluenzaA__ABR28771
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagccgcgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcaacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 76848 - RNA, 1413 nt, Artificial Sequence
  derived and/or modified sequence opt1 from neuraminidase__InfluenzaA__ABR28782
augaaccccaaccagaagaucaucaccaucggcagcaucuccaucgccaucgggauccugagccucaugcugcagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccucugcuccaucagcggcugggccaucuacaccaaggacaacuccauccggaucgggagcaagggcgacguguucgugauccgcgagccguucaucuccugcagccaccuggagugccggacguucuuccugacccagggggcccuccugaacgacaagcacuccaacggcaccgucaaggaccgcagccccuaccgggcccugauguccugcccccucggggaggcgcccagcccguacaacagcaaguucgaguccguggccuggagcgccuccgccugccacgacggcaugggcuggcugaccaucgggaucagcggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccagcaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacagcaacuucuccgucaagcaggacgugguggccaucacggacuggagcggguacagcggcuccuucguccagcaccccgagcugaccggccuggacugcauccgccccugcuucuggguggagcucguccgggggcugccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 76849 - RNA, 1410 nt, Artificial Sequence; identical to SEQ ID NO: 75852
  derived and/or modified sequence opt1 from neuraminidase__InfluenzaA__ABR28793

SEQ ID NO: 76850 - RNA, 1413 nt, Artificial Sequence; identical to SEQ ID NO: 75836
  derived and/or modified sequence opt1 from neuraminidase__InfluenzaA__ABR28804

SEQ ID NO: 76851 - RNA, 1410 nt, Artificial Sequence; identical to SEQ ID NO: 75738
  derived and/or modified sequence opt1 from neuraminidase__InfluenzaA__ABR28815

SEQ ID NO: 76852 - RNA, 1410 nt, Artificial Sequence; identical to SEQ ID NO: 75162
  derived and/or modified sequence opt1 from neuraminidase__InfluenzaA__ABR28826

SEQ ID NO: 76853 - RNA, 1413 nt, Artificial Sequence; identical to SEQ ID NO: 75404
  derived and/or modified sequence opt1 from neuraminidase__InfluenzaA__ABR28837

SEQ ID NO: 76854 - RNA, 1413 nt, Artificial Sequence
  derived and/or modified sequence opt1 from neuraminidase__InfluenzaA__ABR28848
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgucgggaaggacaagaccagcgugacccuggcgggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcccccagcccguacaacagcaaguucgaguccguggcguggagcgccuccgccugccacgacggcaugggcuggcucaccaucgggaucagcggccccgacaacggggccgucgcggugcugaaguacaacggcaucaucacggagaccaucaaguccuggaagaagcagauccugcgcacccaggagagcgagugcgugugcgucaacggcuccugcuucaccaucaugacggacgggcccagcaacggcgccgccuccuacaagaucuucaagaucgagaaggggaagaucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgccaacggggugaagggcuucagcuacaaguacggcaacgggguguggaucggccgcaccaaguccaaccggcugcgcaagggguucgagauggucugggaccccaacggcuggaccgacaccgacagcgacuucuccgugaagcaggacguggucgcgaucacggacuggagcggguacagcggcuccuucgugcagcaccccgagcucaccggccugaacugcauccggcccugcuucugggucgagcuggugcgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 76855 - RNA, 1410 nt, Artificial Sequence
  derived and/or modified sequence opt1 from neuraminidase__InfluenzaA__ABR28859
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgcgccaggugugcaucgccugguccagcuccagcugccacgacgggaaggcguggcugcacgucugcgugaccggcgacgacgagaacgccaccgccuccuucaucuacaacgggcggcugguggacagcaucggcuccuggagcaagaagauccuccgcacccaggaguccgagugcgucugcaucaacggcacgugcaccguggugaugaccgacgggagcgccuccggcaaggcggacaccaagauccuguucaucgaggaggggaagaucguccacaucagcacgcugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggaccagcaacagcaucgucguguucugcgggaccuccggcaccuacgggacgggcagcuggccggacggcgccgacaucaaccugaugcccaucuga

SEQ ID NO: 76856 - RNA, 1410 nt, Artificial Sequence
  derived and/or modified sequence opt1 from neuraminidase__InfluenzaA__ABR28870
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaccgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacgcaggaguccgagugcgucugcaucaacgggaccugcaccguggugaugaccgacggcagcgccuccgggaaggcggacacgaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 76857 - RNA, 1410 nt, Artificial Sequence
  derived and/or modified sequence opt1 from neuraminidase__InfluenzaA__ABR28881
augaaccccaaccagaagaucaucaccaucggcagcgugucccugaccaucgccacggucugcuuccucaugcagaucgccauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggcguggcugcacgugugcgugaccggggacgacgagaacgccaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggcggacaccaagauccuguucaucgaggagggcaagaucgugcacaucagcacgcugagcggguccgcccagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaccaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggacguacggcaccgggagcuggccggacggcgccgacaucaaccugaugcccaucuga

SEQ ID NO: 76858 - RNA, 1410 nt, Artificial Sequence; identical to SEQ ID NO: 75722
  derived and/or modified sequence opt1 from neuraminidase__InfluenzaA__ABR28892

SEQ ID NO: 76859 - RNA, 1413 nt, Artificial Sequence; identical to SEQ ID NO: 75394
  derived and/or modified sequence opt1 from neuraminidase__InfluenzaA__ABR28903

SEQ ID NO: 76860 - RNA, 1410 nt, Artificial Sequence
  derived and/or modified sequence opt1 from neuraminidase__InfluenzaA__ABR28925
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggaggugcugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 76861 - RNA, 1410 nt, Artificial Sequence
  derived and/or modified sequence opt1 from neuraminidase__InfluenzaA__ABR88082
auggaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaucaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 76862 - RNA, 1413 nt, Artificial Sequence
  derived and/or modified sequence opt1 from neuraminidase__InfluenzaA__ABS00324
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacgcagggggcccugcucaacgacaagcacagcaacggcaccgugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagacgaucaagagcuggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagagcaucgagcuggacgcccccaacucccacuacgaggagugcagcugcuaccccgacgccggcacggugaugugcgugugccgcgacaacuggcggggguccaaccgccccugggucagcuucaaccagucccucgacuaccagaucggcuacaucugcagcggcguguucggggacaacccgcggcccaaggacggcaagggguccugcgaccccgugaccgucgacggcgcggacggggugaagggcuucagcuaccgcuacggcaacgggguguggaucggccggaccaaguccaacagcucccgccggggguucgagaugaucugggaccccaacggcuggacggacaccgacagcaaguuccuggucaagcaggacgugguggccaugaccgacuggagcggguacuccggcagcuucguccagcacccggagcugaccggccucgacugcaugcgccccugcuucuggguggagcugauccgggggcgcccccgggagaacacgaccaucuggaccuccggcagcuccaucagcuucugcggggucaacggcgacaccgccaacugguccuggcccgacggcagcgagcugccguucacgaucgacaaguga

SEQ ID NO: 76863 - RNA, 1410 nt, Artificial Sequence; identical to SEQ ID NO: 75122
  derived and/or modified sequence opt1 from neuraminidase__InfluenzaA__ABS49902

SEQ ID NO: 76864 - RNA, 1410 nt, Artificial Sequence
  derived and/or modified sequence opt1 from neuraminidase__InfluenzaA__ABS49913
augaaccccaaccagaagaucaucaccaucggcagcgugucccugaccaucgccacggucugcuuccucaugcagaucgccauccuggugaccaccgugacccugcacuuccgccaguacgagugcgacagcccgacgaacaaccaggucaugcccugcgagcccaucaucaucgagcggaacaucaccgagaucguguaccucaacaacaccaccaucgagaaggagaucugccccaagcugguggaguaccgcaacugguccaagccgcagugcaagaucacgggguucgcgcccuucagcaaggacaacuccauccggcugagcgccggcggggacaucugggucacccgcgagcccuacguguccugcgaccccggcaagugcuaccaguucgcccucgggcagggcaccacccuggacaacaagcacagcaacgacacgauccacgaccggaucccgcaccgcacccugcucaugaacgagcugggcgugcccuuccaccuggggacccggcaggucugcaucgccugguccagcuccagcugccacgacggcaaggccuggcuccacgugugcgugaccggggacgacaagaacgcgacggccuccuucaucuacgacggccgccuggucgacagcaucggguccuggagccagaacauccugcggacccaggaguccgagugcgugugcaucaacgggaccugcaccguggucaugacggacggcagcgccuccggccgcgccgacacccggauccucuucaucgaggagggcaagaucgugcacaucagcccccugagcggguccgcgcagcacguggaggagugcagcugcuacccccgcuacccgggcguccggugcaucugccgcgacaacuggaagggcuccaaccggcccgugguggacaucaacgucgaggacuacagcaucgacuccagcuacgugugcuccgggcuggugggcgacacgccccgcaacaacgaccggagcuccaacagcaacugccgcaaccccaacaacgagcgggggaaccacggcgucaaggggugggccuucgacgacggcaacgacguguggaugggccgcaccaucuccaaggaccuccggagcggguacgagaccuucaaggucaucggcgggugguccaccccgaacagcaagucccagaucaaccgccaggugaucguggacagcgacaaccgcuccggcuacagcgggaucuucuccgucgagggcaagagcugcaucaaccggugcuucuacguggagcugauccgcggccgggagcaggagacccgcgugugguggaccagcaacuccaucgucguguucugcgggacgagcggcaccuacgggaccggcuccuggcccgacggggccgacaucaaccugaugcccaucuga

SEQ ID NO: 76865 - RNA, 1410 nt, Artificial Sequence; identical to SEQ ID NO: 75852
  derived and/or modified sequence opt1 from neuraminidase__InfluenzaA__ABS49968

SEQ ID NO: 76866 - RNA, 1413 nt, Artificial Sequence; identical to SEQ ID NO: 76848
  derived and/or modified sequence opt1 from neuraminidase__InfluenzaA__ABS49979

SEQ ID NO: 76867 - RNA, 1413 nt, Artificial Sequence
  derived and/or modified sequence opt1 from neuraminidase__InfluenzaA__ABS49990
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucauccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacagcaacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccagcggcuccagcaucuccuucugcggggugaacagcgacacggccaacugguccuggcccgacggcgccgagcugcccuucaccaucgacaaguga

SEQ ID NO: 76868 - RNA, 1410 nt, Artificial Sequence; identical to SEQ ID NO: 75738
  derived and/or modified sequence opt1 from neuraminidase__InfluenzaA__ABS50001

SEQ ID NO: 76869 - RNA, 1410 nt, Artificial Sequence; identical to SEQ ID NO: 75738
  derived and/or modified sequence opt1 from neuraminidase__InfluenzaA__ABS50012

SEQ ID NO: 76870 - RNA, 1410 nt, Artificial Sequence
  derived and/or modified sequence opt1 from neuraminidase__InfluenzaA__ABS50023
augaaccccaaccagaagaucaucaccaucggcagcgugucccugaccaucgccacgaucugcuuccucaugcagaucgccguccuggugaccaccgugacccugcacuucaagcaguacgagugcaacccgccgcccaacaaccaggucaugcucugcgagcccacgaucaucgagcgcaacaucaccgagaucguguaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgucagcugcgacccggacaagugcuaccaguucgcccugggccaggggaccacgcugaacaacggccacuccaacgacaucgugcacgaccgcacccccuaccggacccuccugaugaacgagcugggcgugcccuuccaccucgggaccaagcaggucugcaucgccuggagcuccagcuccugccacgacggcaaggcguggcugcacgugugcgugacgggggacgacgagaacgccaccgccagcuucaucuacaacggccgccuggucgacuccaucgggagcugguccaagaagauccuccggacccaggagagcgagugcgugugcaucaacgggaccugcacgguggucaugaccgacggcuccgccagcgggaaggcggacaccaagauccuguucaucgaggagggcaagaucgugcacaccucccugcucagcgggagcgcccagcacguggaggagugcuccugcuacccccgcuacccgggcguccggugcgugugccgcgacaacuggaagggcagcaaccggcccaucguggacaucaacgucaaggacuacuccaucgugagcuccuacgugugcagcgggcuggucggcgacacgccccgcaagaacgacuccagcuccagcucccacugccuggaccccaacaacgaggagggcggccacggggugaagggcugggccuucgacgacggcaacgacgucuggauggggcggaccaucagcgagaagcuccgcuccggcuacgagaccuucaaggugaucgagggguggagcaagccgaacuccaagcugcagaucaaccgccaggugaucgucgaccggggcaaccggagcggguacuccggcaucuucagcguggagggcaaguccugcaucaaccgcugcuucuacguggagcugauccgggggcgcaagcaggagaccgagguccucuggacgagcaacagcaucgugguguucugcggcaccuccgggaccuacggcaccgggagcuggcccgacggcgccgacaucaaccugaugcccaucuga

SEQ ID NO: 76871 - RNA, 1410 nt, Artificial Sequence; identical to SEQ ID NO: 75738
  derived and/or modified sequence opt1 from neuraminidase__InfluenzaA__ABS50034

SEQ ID NO: 76872 - RNA, 1410 nt, Artificial Sequence
  derived and/or modified sequence opt1 from neuraminidase__InfluenzaA__ABS50045
augaaccccaaccagaagaucaucaccaucggcagcgugucccugaccaucgccacgaucugcuuccucaugcagaccgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccauccacgaccgcaccccguaccggacgcuccugaugaacgagcugggcguccccuuccaccucgggacccgccaggugugcaucgccugguccagcuccagcugccacgacggcaaggcguggcugcacgugugcgucaccggggacgacgagaacgccaccgccuccuucaucuacaacggccggcugguggacagcaucggguccuggagcaagaagauccuccgcacgcaggaguccgagugcgugugcaucaacgggaccugcaccgucgugaugaccgacggcagcgccuccgggaaggcggacacgaagauccuguucaucgaggagggcaagaucgugcacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggacguacggcaccgggagcuggccggacggcgccgacaucaaccugaugcccaucuga

SEQ ID NO: 76873 - RNA, 1410 nt, Artificial Sequence; identical to SEQ ID NO: 75162
  derived and/or modified sequence opt1 from neuraminidase__InfluenzaA__ABS50056

SEQ ID NO: 76874 - RNA, 1410 nt, Artificial Sequence; identical to SEQ ID NO: 75188
  derived and/or modified sequence opt1 from neuraminidase__InfluenzaA__ABS50067

SEQ ID NO: 76875 - RNA, 1410 nt, Artificial Sequence; identical to SEQ ID NO: 75722
  derived and/or modified sequence opt1 from neuraminidase__InfluenzaA__ABS50078

SEQ ID NO: 76876 - RNA, 1413 nt, Artificial Sequence
  derived and/or modified sequence opt1 from neuraminidase__InfluenzaA__ABS71644
augaagcccaaccagaagaucaucaccaucggcagcaucuccaucgccaucgggaucaucagccugauccuccagaucggcaacaucaucuccaucugggccagccacuccauccagaccgagagccagaaccacacggggaucugcaaccagcgcaucaucaccuacgagaacuccaccugggugaacaacaccuacgucaacaucaacaacacgaacgugguggcggagaaggacaagaccagcgucacccuggccggcaacuccagccugugcuccaucagcgggugggccaucuacaccaaggacaacuccauccggaucggcagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagccgcuucgaguccguggccuggagcgccuccgccugccacgacggcaugggguggcucaccaucggcaucagcggccccgacaacggggcgguggccguccugaaguacaacggcaucaucacggagaccaucaaguccuggaagaagcggauccugcgcacccaggagagcgagugcgugugcaugaacggguccugcuucaccaucaugacggacggccccagcaacggcgccgccuccuacaagaucuucaagaucgagaaggggaaggugaccaagaccauggagcucaacgcccccaacuuccacuacgaggagugcagcugcuacccggacaccggcacggucaugugcgugugccgggacaacuggcacggguccaaccgccccugggugagcuucaaccagaaccuggacuaccagaucggcuacaucugcuccggggucuucggcgacaacccccggcccaaggacggcgaggggagcugcaacccggugaccguggacggcgcggacggggucaagggcuucuccuacaaguacgggaacggcguguggaugggccgcaccaagagcaaccggcugcgcaagggguucgagaugaucugggaccccaacggcuggaccaacacggacuccgacuucagcgugaagcaggacgucguggccaucaccgacugguccggguacagcggcagcuucgugcagcaccccgagcucaccgggcuggacugcauccggcccugcuucugggucgagcuggugcgcggccucccgcgggagaacaccacgaucuggaccuccggcagcuccaucagcuucugcggggucaacuccggcaccgccaacuggagcuggcccgacggggccgagcugcccuucaccaucgacaaguga

SEQ ID NO: 76877 - RNA, 1413 nt, Artificial Sequence
  derived and/or modified sequence opt1 from neuraminidase__InfluenzaA__ABS71646
augaaccccaaccagaagaucaucaccaucggcagcaucuccaucgccaucgggaucaucagccugauccuccagaucggcaacaucaucuccaucugggccagccacuccauccagaccgagagccagaaccacacggggaucugcaaccagcgcaucaucaccuacgagaacuccaccugggugaacaacaccuacgucaacaucaacaacacgaacgugguggcggagaaggacaagaccagcgucacccuggccggcaacuccagccugugcuccaucagcgggugggccaucuacaccaaggacaacuccauccggaucggcagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagccgcuucgaguccguggccuggagcgccuccgccugccacgacggcaugggguggcucaccaucggcaucagcggccccgacaacggggcgguggccguccugaaguacaacggcaucaucacggagaccaucaaguccuggaagaagcggauccugcgcacccaggagagcgagugcgugugcaugaacggguccugcuucaccaucaugacggacggccccagcaacggcgccgccuccuacaagaucuucaagaucgagaaggggaaggugaccaagaccauggagcucaacgcccccaacuuccacuacgaggagugcagcugcuacccggacaccggcacggucaugugcgugugccgggacaacuggcacggguccaaccgccccugggugagcuucaaccagaaccuggacuaccagaucggcuacaucugcuccggggucuucggcgacaacccccggcccaaggacggcgaggggagcugcaacccggugaccguggacggcgcggacggggucaagggcuucuccuacaaguacgggaacggcguguggaugggccgcaccaagagcaaccggcugcgcaagggguucgagaugaucugggaccccaacggcuggaccaacacggacuccgacuucagcgugaagcaggacgucguggccaucaccgacugguccggguacagcggcagcuucgugcagcaccccgagcucaccgggcuggacugcauccggcccugcuucugggucgagcuggugcgcggccucccgcgggagaacaccacgaucuggaccuccggcagcuccaucagcuucugcggggucaacuccggcaccgccaacuggagcuggcccgacggggccgagcugcccuucaccaucgacaaguga

SEQ ID NO: 76878 - RNA, 1413 nt, Artificial Sequence
  derived and/or modified sequence opt1 from neuraminidase__InfluenzaA__ABS71647
augaaccccaaccagaagaucaucaccaucggcagcaucuccaucgccaucgggaucaucagccugauccuccagaucggcaacaucaucuccaucugggccagccacuccauccagaccgagagccagaaccacacggggaucugcaaccagcgcaucaucaccuacgagaacuccaccugggugaacaacaccuacgucaacaucaacaacacgaacgugguggcggagaaggacaagaccagcgucacccuggccggcaacuccagccugugcuccaucagcgggugggccaucuacaccaaggacaacuccauccggaucggcagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagccgcuucgaguccguggccuggagcgccuccgccugccacgacggcaugggguggcucaccaucggcaucagcggccccgacaacggggcgguggccguccugaaguacaacggcaucaucacggagaccaucaaguccuggcggaagcgcauccugcggacccaggagagcgagugcgugugcaugaacggguccugcuucaccaucaugacggacggccccagcaacggcgccgccuccuacaagaucuucaagaucgagaaggggaaggugaccaagaccauggagcucaacgcccccaacuuccacuacgaggagugcagcugcuacccggacaccggcacggucaugugcgugugccgcgacaacuggcacggguccaaccggcccugggugagcuucaaccagaaccuggacuaccagaucggcuacaucugcuccggggucuucggcgacaacccccgccccaaggacggcgaggggagcugcaacccggugaccguggacggcgcggacggggucaagggcuucuccuacaaguacgggaacggcguguggaugggccggaccaagagcaaccgccugcggaagggguucgagaugaucugggaccccaacggcuggaccaacacggacuccgacuucagcgugaagcaggacgucguggccaucaccgacugguccggguacagcggcagcuucgugcagcaccccgagcucaccgggcuggacugcauccgccccugcuucugggucgagcuggugcggggccucccgcgcgagaacaccacgaucuggaccuccggcagcuccaucagcuucugcggggucaacuccggcgccgccaacuggagcuggcccgacggggccgagcugcccuucaccaucgacaaguga

SEQ ID NO: 76879 - RNA, 1413 nt, Artificial Sequence
  derived and/or modified sequence opt1 from neuraminidase__InfluenzaA__ABS71648
augaaccccaaccagaagaucaucaccaucggcagcaucuccaucgccaucgggaucaucagccugauccuccagaucggcaacaucaucuccaucugggccagccacuccauccagaccgggaaccagaaccacacgggcaucugcaaccagcgcaucaucaccuacgagaacagcaccugggugaacaacaccuacgucaacaucaacaacacgaacgugguggcggagaaggacaagaccuccgucacccuggccgggaacagcucccugugcagcaucuccggcugggccaucuacaccaaggacaacagcauccggaucggcuccaagggggacguguucgugauccgcgagccguucaucagcugcucccaccucgagugccggacguucuuccugacccagggcgcccugcucaacgacaagcacagcaacgggaccgucaaggaccgcucccccuaccgggcccugaugagcugcccccugggcgaggcgcccuccccguacaacagccgcuucgagagcguggccugguccgccagcgccugccacgacgggaugggcuggcucaccaucggcaucuccgggcccgacaacggcgcgguggccguccugaaguacaacgggaucaucacggagaccaucaagagcuggaagaagcggauccugcgcacccaggaguccgagugcgugugcaugaacggcagcugcuucaccaucaugacggacggccccuccaacggggccgccagcuacaagaucuucaagaucgagaagggcaaggugaccaagaccaucgagcucaacgcccccaacuuccacuacgaggagugcuccugcuacccggacaccgggacggucaugugcgugugccgggacaacuggcacggcagcaaccgccccuggguguccuucaaccagaaccuggacuaccagaucggguacaucugcagcggcgucuucggcgacaacccccggcccaaggacggggagggcuccugcaacccggugaccguggacggggcggacggcgucaagggguucagcuacaaguacggcaacggcguguggaucgggcgcaccaaguccaaccggcugcgcaagggcuucgagaugaucugggaccccaacggguggaccaacacggacagcgacuucuccgugaagcaggacgucguggccaucaccgacuggagcggcuacuccgggagcuucgugcagcaccccgagcucaccggccuggacugcauccggcccugcuucugggucgagcuggugcgcggccucccgaaggagaacaccacgaucuggaccagcggguccagcaucuccuucugcggcgucaacagcgggaccgccaacugguccuggcccgacggcgccgagcugcccuucaccaucgacaaguga

SEQ ID NO: 76880 - RNA, 1413 nt, Artificial Sequence
  derived and/or modified sequence opt1 from neuraminidase__InfluenzaA__ABS71649
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccagcaaccgggccgccuccuacaagaucuucaagaucgagaagggcaaggugaccaagagcaucgagcucaacgcccccaacuuccacuacgaggagugcuccugcuacccggacaccgggaucgucaugugcgugugccgcgacaacuggcacggcagcaaccggcccuggguguccuucaaccagaaccuggacuaccagaucggguacaucugcagcggcgucuucggcgacaacccccgccccaaggacggggagggcuccugcaacccggugaccguggacggggcggacggcgucaagggguucagcuacaaguacgacaacggcguguggaucggccggacgaaguccaaccgccugcggaagggguucgagaugaucugggaccccaacggcuggaccaacaccgacagcgacuucuccgugaagcaggacgucguggccaucaccgacuggagcggguacagcggcuccuucgugcagcaccccgagcucacggggcuggacugcauccgccccugcuucugggucgagcuggugcggggccucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 76881 - RNA, 1413 nt, Artificial Sequence
  derived and/or modified sequence opt1 from neuraminidase__InfluenzaA__ABS71651
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacagcucccugugcagcguguccggcugggccaucuacaccaaggacaacagcauccggaucggguccaagggcgacguguucgucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcggucgccgugcugaaguacaacggcaucaucacgggcaccaucaagagcuggaagaagcgcauccugcggacccaggaguccgagugcgugugcaugaacgggagcugcuucaccaucaugacggacggccccuccaacggggccgccagcuacaagaucuucaagaucgagaagggcaaggucaccaaguccaucgagcucaacgcccccagcuuccacuacgaggagugcuccugcuacccggacaccgggaccgugaugugcgugugccgcgacaacuggcacggcagcaaccggcccugggucuccuucaaccagaaccuggacuaccagaucggcuacaucugcagcgggguguucggcgacaacccccgccccaaggacggggagggcuccugcaacccggugacggucgacggggcggacggcgugaagggcuucagcuacaaguacgggaacggcguguggcuggggcggaccaaguccaaccgccuccggaagggcuucgagaugaucugggaccccaacggguggaccaacaccgacagcgacuucuccgucaagcaggacgugguggccaucacggacuggagcggcuacagcggcuccuucguccagcaccccgagcugaccgggcuggacugcauccgccccugcuucuggguggagcucguccggggccugccgcgcgagaacaccaccaucuggacgagcggguccagcaucuccuucugcggcgugaacagcaacaccgccaacugguccuggcccgacggcgccgagcugcccuucaccaucgacaaguga

SEQ ID NO: 76882 - RNA, 1413 nt, Artificial Sequence
  derived and/or modified sequence opt1 from neuraminidase__InfluenzaA__ABS71652
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacagcucccugugcagcguguccggcugggccaucuacaccaaggacaacagcauccggaucggguccaagggcgacguguucgucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcggucgccgugcugaaguacaacggcaucaucacggagaccaucaagagcuggaagaagcgcauccugcggacccaggaguccgagugcgugugcaugaacggcagcugcuucaccaucaugacggacgggcccuccaacggcgccgccagcuacaagaucuucaagaucgagaaggggaaggucaccaaguccaucgagcucaacgcccccagcuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcaacaccgccaacugguccuggcccgacggcgccgagcugcccuucaccaucgacaaguga

SEQ ID NO: 76883 - RNA, 1413 nt, Artificial Sequence
  derived and/or modified sequence opt1 from neuraminidase__InfluenzaA__ABS71653
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugaugaucugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaagucccgcgagcucaacgcccccaacuuccacuacgaggagugcagcugcuacccggacaucggcaccgugaugugcgugugccgggacaacuggcacggguccaaccgccccugggucagcuucaaccagaaccuggacuaccagaucggcuacaucugcuccggcguguucggggacaacccccggcccaaggacggcaaggggagcugcaacccggugaccgcggacggcgccgacggggucaagggcuucuccuacaaguacggcaacgggguguggaucggccgcaccaagagcaaccggcugcgcaagggguucgagaugaucugggaccccaacggcuggacggacaccgacuccgacuucagcgugaagcaggacgucguggccaucaccgacugguccggguacagcggcagcuucgugcagcaccccgagcucacgggccuggacugcauccggcccugcuucugggucgagcuggugcgcgggcucccgcgggagaacaccaccaucuggaccuccggcagcuccaucagcuucugcggggucgacuccgacacggccaacuggagcuggcccgacggcgccgagcugcccuucaccaucgacaaguga

SEQ ID NO: 76884 - RNA, 1410 nt, Artificial Sequence
  derived and/or modified sequence opt1 from neuraminidase__InfluenzaA__ABS71655
augaaccccaucaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76885 - RNA, 1410 nt, Artificial Sequence
  derived and/or modified sequence opt1 from neuraminidase__InfluenzaA__ABS71657
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacgccuggaugggccgcaccaucagcgagaagucccggagcggcuacgagaccuucaaggugaucgaggggugguccaaccccaacagcaagcugcagaucaaccgccaggucaucguggaccggggcaaccgcuccggguacagcggcaucuucagcguggaggggaaguccugcaucaaccggugcuucuacgucgagcugauccgcggccggaaggaggagaccgaggugcucuggaccagcaacuccaucguggucuucugcggcaccagcgggacguacggcaccggguccuggccggacggcgccgacaucaaccugaugcccaucuga

SEQ ID NO: 76886 - RNA, 1410 nt, Artificial Sequence
  derived and/or modified sequence opt1 from neuraminidase__InfluenzaA__ABS71659
augaaccccaucaagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucggcgagaagucccggagcggguacgagaccuucaaggucaucgagggcuggagcaaccccaacuccaagcugcagaucaaccgccaggugaucguggaccgggggaaccgcagcggcuacuccgggaucuucagcgucgagggcaagagcugcaucaaccggugcuucuacguggagcugauccgcggccggaaggaggagaccgaggugcucuggaccuccaacagcaucgucguguucugcgggaccuccggcacguacgggaccggcagcuggccggacggggccgacaucaaccacaugcccaucuga

SEQ ID NO: 76887 - RNA, 1410 nt, Artificial Sequence
  derived and/or modified sequence opt1 from neuraminidase__InfluenzaA__ABS71660
augaaccccaucaagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 76888 - RNA, 1410 nt, Artificial Sequence
  derived and/or modified sequence opt1 from neuraminidase__InfluenzaA__ABS71661
auguaccccaucaagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 76889 - RNA, 1410 nt, Artificial Sequence
  derived and/or modified sequence opt1 from neuraminidase__InfluenzaA__ABS71662
augaaccccaucaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 76890 - RNA, 1410 nt, Artificial Sequence
  derived and/or modified sequence opt1 from neuraminidase__InfluenzaA__ABS71663
auguaccccaucaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgaccagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcugcagaugaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 76891 - RNA, 1410 nt, Artificial Sequence
  derived and/or modified sequence opt1 from neuraminidase__InfluenzaA__ABU40956
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaacugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucaucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 76892 - RNA, 1410 nt, Artificial Sequence
  derived and/or modified sequence opt1 from neuraminidase__InfluenzaA__ABU50651
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 76893 - RNA, 1410 nt, Artificial Sequence
  derived and/or modified sequence opt1 from neuraminidase__InfluenzaA__ABU80180
augaaccccaaccagaagaucaucaccaucggcagcgugucccugaccaucgccacgaucugcuuccucaugcagaucgccauccuggucaccaccgugacccugcacuucaagcaguacgagugcaacagcuucccgaacaaccaggugaugcucugcgagcccacgaucaucgagcgcaacaucaccgagaucgucuaccugaccaacaccacgaucgagaaggagaucugccccaagcuggcggaguaccggaacugguccaagccccagugcaacaucaccggguucgccccguucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcacccccuaccggacccuccugaugaacgagcugggcgugccguuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggcccaucguggacaucaacgugaaggacuacuccaucgucagcuccuacgugugcagcgggcucgugggcgacaccccgcgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagacggaggugcuguggaccuccaacagcaucgucguguucugcggcaccuccgggaccuacggcacggggagcuggcccgacggcgccgacaucaaccucaugccgaucuga

SEQ ID NO: 76894 - RNA, 1413 nt, Artificial Sequence; identical to SEQ ID NO: 75836
  derived and/or modified sequence opt1 from neuraminidase__InfluenzaA__ABU80301

SEQ ID NO: 76895 - RNA, 1413 nt, Artificial Sequence
  derived and/or modified sequence opt1 from neuraminidase__InfluenzaA__ABU80312
augaacaccaaccagaagaucaucaccaucggcagcaucuccaucgccaucgggaucaucagccugaugcuccagaucggcaacaucaucuccaucugggccagccacuccauccagacggggagccagaaccacaccggcaucugcaaccagcgcaucaucaccuacgagaacuccaccugggugaaccacacguacgucaacaucaacaacaccaacgugguggcggggaaggacaagaccagcgucacccuggccggcaacuccagccugugcuccaucagcggcugggccaucuacacgaaggacaacuccauccggaucgggagcaagggcgacguguucgugaugcgcgagcccuucaucuccugcagccaccucgagugccggaccuucuuccugacccagggggcccugcucaacgacaagcacuccaacggcaccgucaaggaccgcagcccguaccgggcccugauguccugcccccugggggaggcgcccagccccuacaacagcaaguucgaguccguggccuggagcgccuccgccugccacgacggcaugggcuggcucacgaucgggaucagcggcccggacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuaccccgacaccggcacggugaugugcgugugccgcgacaacuggcacgggagcaaccggccgugggucuccuucaaccagaaccuggacuaccagaucggcuacaucugcagcggcguguucggggacaacccccgccccaaggacggcgagggguccugcaaccccgugaccgucgacggcgcggacggggugaagggcuucagcuacaaguacggcaacgggguguggaucggccggaccaaguccaaccgccugcggaagggguucgagaugaucugggacccgaacggcuggaccgacacggacagcaacuucuccgucaagcaggacgugguggccaucaccgacuggagcggguacagcggcuccuucguccagcaccccgagcucaccggccuggacugcauccgccccugcuucuggguggagcugguccgggggcucccccgcgagaacaccacgaucuggaccagcggcuccagcaucuccuucugcggggugaacagcgacaccgccaacugguccuggccggacggcgccgagcugcccuucaccaucgacaaguga

SEQ ID NO: 76896 - RNA, 1410 nt, Artificial Sequence; identical to SEQ ID NO: 75738
  derived and/or modified sequence opt1 from neuraminidase__InfluenzaA__ABU80323

SEQ ID NO: 76897 - RNA, 1410 nt, Artificial Sequence
  derived and/or modified sequence opt1 from neuraminidase__InfluenzaA__ABU80334
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagacccuccgcacgcaggaguccgagugcgucugcaucaacgggaccugcaccguggugaugaccgacggcagcgccuccgggaaggcggacacgaagauccuguucaucgaggagggcaagaucauccacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggacguacggcaccgggagcuggccggacggcgccgacaucaaccugaugcccaucuga

SEQ ID NO: 76898 - RNA, 1410 nt, Artificial Sequence; identical to SEQ ID NO: 75162
  derived and/or modified sequence opt1 from neuraminidase__InfluenzaA__ABU92762

SEQ ID NO: 76899 - RNA, 1410 nt, Artificial Sequence
  derived and/or modified sequence opt1 from neuraminidase__InfluenzaA__ABU92764
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucauggagcgcaacaucaccgagaucgucuaccugaccaacaccacgaucgagaaggagaucugccccaagcuggcggaguaccggaacugguccaagccgcagugcaacgugaccggguucgcccccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggcguggcugcacgugugcgugaccggggacgacgagaacgccaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggcggacaccaagauccuguucaucgaggagggcaagaucgugcacaucagcacgcugagcggguccgcccagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggaagaaggaggagaccgaggucugguggaccagcaacagcaucgugguguucugcggcaccuccgggaccuacggcacggggagcuggccggacggcgccgacaucaaccugaugcccaucuga

SEQ ID NO: 76900 - RNA, 1410 nt, Artificial Sequence; identical to SEQ ID NO: 75162
  derived and/or modified sequence opt1 from neuraminidase__InfluenzaA__ABU92765

SEQ ID NO: 76901 - RNA, 1410 nt, Artificial Sequence; identical to SEQ ID NO: 75162
  derived and/or modified sequence opt1 from neuraminidase__InfluenzaA__ABU92766

SEQ ID NO: 76902 - RNA, 1410 nt, Artificial Sequence; identical to SEQ ID NO: 75162
  derived and/or modified sequence opt1 from neuraminidase__InfluenzaA__ABU92767

SEQ ID NO: 76903 - RNA, 1410 nt, Artificial Sequence; identical to SEQ ID NO: 75162
  derived and/or modified sequence opt1 from neuraminidase__InfluenzaA__ABU92768

SEQ ID NO: 76904 - RNA, 1410 nt, Artificial Sequence; identical to SEQ ID NO: 75069
  derived and/or modified sequence opt1 from neuraminidase__InfluenzaA__ABU92769

SEQ ID NO: 76905 - RNA, 1410 nt, Artificial Sequence; identical to SEQ ID NO: 75261
  derived and/or modified sequence opt1 from neuraminidase__InfluenzaA__ABU92770

SEQ ID NO: 76906 - RNA, 1410 nt, Artificial Sequence
  derived and/or modified sequence opt1 from neuraminidase__InfluenzaA__ABU92771
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccaacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 76907 - RNA, 1410 nt, Artificial Sequence
  derived and/or modified sequence opt1 from neuraminidase__InfluenzaA__ABU92772
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaacauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76908 - RNA, 1410 nt, Artificial Sequence
  derived and/or modified sequence opt1 from neuraminidase__InfluenzaA__ABU92773
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaccgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacgcaggaguccgagugcgucugcaucaacgggaccugcaccguggugaugaccgacggcagcgccuccgggaaggcggacacgaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcacguccgggaccuacggcaccgggagcuggccggacggcgccgacaucaaccugaugcccaucuga

SEQ ID NO: 76909 - RNA, 1410 nt, Artificial Sequence
  derived and/or modified sequence opt1 from neuraminidase__InfluenzaA__ABU92774
augaaccccaaccgcaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcggaacaucaccgagaccgucuaccugaccaacacgaccaucgagaaggagaucugccccaagcuggcggaguaccgcaacugguccaagccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggacgacccugaacaacggccacagcaacgacaccguccacgaccggaccccguaccgcacgcuccugaugaacgagcugggcgugcccuuccaccucgggacccgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcacguccgggaccuacggcaccgggagcuggccggacggcgccgacaucaaccugaugcccaucuga

SEQ ID NO: 76910 - RNA, 1410 nt, Artificial Sequence
  derived and/or modified sequence opt1 from neuraminidase__InfluenzaA__ABU92775
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 76911 - RNA, 1410 nt, Artificial Sequence; identical to SEQ ID NO: 75335
  derived and/or modified sequence opt1 from neuraminidase__InfluenzaA__ABU92777

SEQ ID NO: 76912 - RNA, 1410 nt, Artificial Sequence
  derived and/or modified sequence opt1 from neuraminidase__InfluenzaA__ABU92778
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 76913 - RNA, 1410 nt, Artificial Sequence; identical to SEQ ID NO: 75233
  derived and/or modified sequence opt1 from neuraminidase__InfluenzaA__ABU92779

SEQ ID NO: 76914 - RNA, 1410 nt, Artificial Sequence; identical to SEQ ID NO: 75233
  derived and/or modified sequence opt1 from neuraminidase__InfluenzaA__ABU92780

SEQ ID NO: 76915 - RNA, 1410 nt, Artificial Sequence; identical to SEQ ID NO: 75233
  derived and/or modified sequence opt1 from neuraminidase__InfluenzaA__ABU92781

SEQ ID NO: 76916 - RNA, 1410 nt, Artificial Sequence
  derived and/or modified sequence opt1 from neuraminidase__InfluenzaA__ABU92782
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggcgcgaggagaccgaggugugguggacgagcaacagcaucgucguguucugcggcaccuccgggaccuacggcaccgggagcuggccggacggcgccgacaucaaccugaugcccaucuga

SEQ ID NO: 76917 - RNA, 1410 nt, Artificial Sequence; identical to SEQ ID NO: 75233
  derived and/or modified sequence opt1 from neuraminidase__InfluenzaA__ABU92783

SEQ ID NO: 76918 - RNA, 1410 nt, Artificial Sequence; identical to SEQ ID NO: 75233
  derived and/or modified sequence opt1 from neuraminidase__InfluenzaA__ABU92784

SEQ ID NO: 76919 - RNA, 1410 nt, Artificial Sequence; identical to SEQ ID NO: 75233
  derived and/or modified sequence opt1 from neuraminidase__InfluenzaA__ABU92785

SEQ ID NO: 76920 - RNA, 1410 nt, Artificial Sequence; identical to SEQ ID NO: 75233
  derived and/or modified sequence opt1 from neuraminidase__InfluenzaA__ABU92786

SEQ ID NO: 76921 - RNA, 1410 nt, Artificial Sequence
  derived and/or modified sequence opt1 from neuraminidase__InfluenzaA__ABU92787
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccggcaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 76922 - RNA, 1410 nt, Artificial Sequence
  derived and/or modified sequence opt1 from neuraminidase__InfluenzaA__ABU92789
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcagcaucaccggguucgcgcccuucuccaaggacaacagcauccgccuguccgccggcggggacaucugggucacccgggagcccuacgugagcugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuacccgggcguccggugcgugugccgcgacaacuggaaggggagcaaccggcccaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgcagcggcuacgagaccuucaaggucaucgaggggugguccaacccgaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggacguacggcaccggguccuggcccgacggcgccgacaucaaccugaugcccaucuga

SEQ ID NO: 76923 - RNA, 1410 nt, Artificial Sequence; identical to SEQ ID NO: 75335
  derived and/or modified sequence opt1 from neuraminidase__InfluenzaA__ABU92790

SEQ ID NO: 76924 - RNA, 1410 nt, Artificial Sequence
  derived and/or modified sequence opt1 from neuraminidase__InfluenzaA__ABU92791
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaccgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 76925 - RNA, 1410 nt, Artificial Sequence
  derived and/or modified sequence opt1 from neuraminidase__InfluenzaA__ABU92792
augaaccccaaccagaagaucaucaccaucggcagcgugucccugaccaucagcacgaucugcuucuucaugcagaucgccauccucaucaccaccgucacccugcacuucaagcaguacguguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccguggugagcugguccaaggacauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaagaacuacuccaucgugagcuccuacgucugcagcggccuggugggcgacacgccccgcaagaccgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggugaucgaggggugguccaaccccaacagcaagcuccagaucaaccggcaggucaucguggaccgcggcaaccgguccggguacagcggcaucuucuccguggagggcaagagcugcaucaaccgcugcuucuacgucgagcugauccgggggcgcaaggaggagaccgaggugcuguggaccagcaacuccaucguggucuucugcggcacgagcgggaccuacggcaccggguccuggccggacggcgccgacaucaaccucaugcccaucuga

SEQ ID NO: 76926 - RNA, 1410 nt, Artificial Sequence; identical to SEQ ID NO: 75815
  derived and/or modified sequence opt1 from neuraminidase__InfluenzaA__ABU92793

SEQ ID NO: 76927 - RNA, 1410 nt, Artificial Sequence; identical to SEQ ID NO: 76922
  derived and/or modified sequence opt1 from neuraminidase__InfluenzaA__ABU92794

SEQ ID NO: 76928 - RNA, 1410 nt, Artificial Sequence; identical to SEQ ID NO: 75233
  derived and/or modified sequence opt1 from neuraminidase__InfluenzaA__ABU92795

SEQ ID NO: 76929 - RNA, 1410 nt, Artificial Sequence; identical to SEQ ID NO: 75233
  derived and/or modified sequence opt1 from neuraminidase__InfluenzaA__ABU92796

SEQ ID NO: 76930 - RNA, 1410 nt, Artificial Sequence
  derived and/or modified sequence opt1 from neuraminidase__InfluenzaA__ABU92797
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagcgcauccuccggacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucaacgagaagcugcgcagcggcuacgagaccuucaaggucaucgaggggugguccaagcccaacagcaagcuccagaucaaccgccaggugaucguggagcggggcaaccgguccggguacagcggcaucuucuccgucgagggcaagagcugcaucaaccgcugcuucuacguggagcugauccgggggcgcaaggaggagaccgaggugugguggacguccaacagcaucgucguguucugcggcaccagcgggaccuacggcaccggguccuggccggacggcgccgacaucaaccugaugcccaucuga

SEQ ID NO: 76931 - RNA, 1410 nt, Artificial Sequence; identical to SEQ ID NO: 75233
  derived and/or modified sequence opt1 from neuraminidase__InfluenzaA__ABU92798

SEQ ID NO: 76932 - RNA, 1410 nt, Artificial Sequence; identical to SEQ ID NO: 75233
  derived and/or modified sequence opt1 from neuraminidase__InfluenzaA__ABU92799

SEQ ID NO: 76933 - RNA, 1410 nt, Artificial Sequence; identical to SEQ ID NO: 75233
  derived and/or modified sequence opt1 from neuraminidase__InfluenzaA__ABU92800

SEQ ID NO: 76934 - RNA, 1410 nt, Artificial Sequence
  derived and/or modified sequence opt1 from neuraminidase__InfluenzaA__ABU92801
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucguccaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 76935 - RNA, 1410 nt, Artificial Sequence; identical to SEQ ID NO: 75233
  derived and/or modified sequence opt1 from neuraminidase__InfluenzaA__ABU92802

SEQ ID NO: 76936 - RNA, 1410 nt, Artificial Sequence; identical to SEQ ID NO: 75233
  derived and/or modified sequence opt1 from neuraminidase__InfluenzaA__ABU92804

SEQ ID NO: 76937 - RNA, 1410 nt, Artificial Sequence
  derived and/or modified sequence opt1 from neuraminidase__InfluenzaA__ABU92805
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 76938 - RNA, 1410 nt, Artificial Sequence; identical to SEQ ID NO: 76937
  derived and/or modified sequence opt1 from neuraminidase__InfluenzaA__ABU92806

SEQ ID NO: 76939 - RNA, 1410 nt, Artificial Sequence
  derived and/or modified sequence opt1 from neuraminidase__InfluenzaA__ABU92808
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggccgaguaccggaacugguccaagccgcagugcaacaucaccggguucgcgcccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccagcuccagcugccacgacggcaaggccuggcugcacgucugcgugaccggggacgacaagaacgcgaccgccuccuucaucuacaacggccggcugguggacagcaucggguccuggagcaagaagauccuccgcacgcaggaguccgagugcgucugcaucaacgggaccugcaccguggugaugaccgacggcagcgccuccgggaaggccgacacgaagauccuguucaucgaggagggcaagaucauccacaucagcacccugagcggguccgcgcagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcggccacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcggggcaaccgcuccggguacagcggcaucuucuccguggagggcaagagcugcaucaaccggugcuucuacgucgagcugauccgcgggcggaaggaggagaccgaggugugguggaccagcaacuccaucguggucuucugcggcaccagcgggacguacggcaccggguccuggccggacggcgccgacaucaaccugaugcccaucuga

SEQ ID NO: 76940 - RNA, 1410 nt, Artificial Sequence
  derived and/or modified sequence opt1 from neuraminidase__InfluenzaA__ABU92809
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgacgugcuguggaccagcaacuccaucgucguguucugcgggaccagcggcacguacgggaccggcuccuggccggacggggccgacaucaaccugaugcccaucuga

SEQ ID NO: 76941 - RNA, 1410 nt, Artificial Sequence
  derived and/or modified sequence opt1 from neuraminidase__InfluenzaA__ABU92810
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagggcgggaaccggagcggcuacuccggcaucuucagcgucgaggggaaguccugcaucaaccgcugcuucuacguggagcugauccggggccgcaaggaggagaccgaggugugguggacgagcaacagcaucgucguguucugcgggaccuccggcaccuacgggaccggcagcuggccggacggcgccgacaucaaccugaugcccaucuga

SEQ ID NO: 76942 - RNA, 1410 nt, Artificial Sequence
  derived and/or modified sequence opt1 from neuraminidase__InfluenzaA__ABU92811
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaugaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccgugggcgacaucugggugacccgggagcccuacgucuccugcgaccccgacaagugcuaccaguucgcccuggggcagggcaccacccugaacaacgggcacagcaacgacacggugcacgaccgcaccccguaccggacccuccugaugaacgagcugggcgugcccuuccaccucggcacccgccaggucugcaucgcgugguccagcuccagcugccacgacgggaaggccuggcugcacgugugcgugacgggcgacgacaagaacgccaccgccuccuucaucuacaacgggcggcuggucgacagcaucggcuccuggagcaagaagauccuccgcacccaggaguccgagugcgugugcaucaacgggaccugcacgguggucaugaccgacggcagcgcguccggcaaggccgacaccaagauccuguucaucgaggaggggaagaucgugcacaucagcacccugagcggcuccgcccagcacguggaggagugcagcugcuacccccgguaccccgggguccgcugcgugugccgggacaacuggaagggcuccaaccgcccgaucguggacaucaacgucaaggacuacagcaucguguccagcuacgugugcuccggccucgucggggacacgccccggaagaacgacagcuucuccagcucccacugccuggaccccaacaacgaggagggcgggcacggcgugaaggggugggccuucgacgacggcaacgacgucuggaugggccgcaccaucagcgagaagcugcgguccggguacgagaccuucaaggugaucgagggcuggagcaagcccaacuccaagcuccagaucaaccgccaggugaucgucgagcgggggaaccgcagcggcuacuccgggaucuucagcguggagggcaaguccugcaucaaccggugcuucuacguggagcugauccgcggccggaaggaggagaccgaggucugguggacgagcaacagcaucgugguguucugcgggaccuccggcaccuacgggaccggcagcuggccggacggggccgacaucaaccugaugcccaucuga

SEQ ID NO: 76943 - RNA, 1410 nt, Artificial Sequence; identical to SEQ ID NO: 75233
  derived and/or modified sequence opt1 from neuraminidase__InfluenzaA__ABU92814

SEQ ID NO: 76944 - RNA, 1410 nt, Artificial Sequence; identical to SEQ ID NO: 75722
  derived and/or modified sequence opt1 from neuraminidase__InfluenzaA__ABU92815

SEQ ID NO: 76945 - RNA, 1410 nt, Artificial Sequence; identical to SEQ ID NO: 75233
  derived and/or modified sequence opt1 from neuraminidase__InfluenzaA__ABU92816

SEQ ID NO: 76946 - RNA, 1410 nt, Artificial Sequence
  derived and/or modified sequence opt1 from neuraminidase__InfluenzaA__ABU92817
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgaguccaagagcugcaucaaccggugcuucuacguggagcugauccgcggccggaaggaggagaccgaggugugguggacgagcaacuccaucgucguguucugcgggaccagcggcaccuacgggaccggcuccuggccggacggggccgacaucaaccugaugcccaucuga

SEQ ID NO: 76947 - RNA, 1410 nt, Artificial Sequence; identical to SEQ ID NO: 75233
  derived and/or modified sequence opt1 from neuraminidase__InfluenzaA__ABU92818

SEQ ID NO: 76948 - RNA, 1410 nt, Artificial Sequence; identical to SEQ ID NO: 75233
  derived and/or modified sequence opt1 from neuraminidase__InfluenzaA__ABU92819

SEQ ID NO: 76949 - RNA, 1410 nt, Artificial Sequence; identical to SEQ ID NO: 75233
  derived and/or modified sequence opt1 from neuraminidase__InfluenzaA__ABU92821

SEQ ID NO: 76950 - RNA, 1410 nt, Artificial Sequence; identical to SEQ ID NO: 75233
  derived and/or modified sequence opt1 from neuraminidase__InfluenzaA__ABU92822

SEQ ID NO: 76951 - RNA, 1410 nt, Artificial Sequence; identical to SEQ ID NO: 75145
  derived and/or modified sequence opt1 from neuraminidase__InfluenzaA__ABU92823

SEQ ID NO: 76952 - RNA, 1410 nt, Artificial Sequence
  derived and/or modified sequence opt1 from neuraminidase__InfluenzaA__ABU92824
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggcgcaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 76953 - RNA, 1410 nt, Artificial Sequence
  derived and/or modified sequence opt1 from neuraminidase__InfluenzaA__ABU92825
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 76954 - RNA, 1410 nt, Artificial Sequence; identical to SEQ ID NO: 76953
  derived and/or modified sequence opt1 from neuraminidase__InfluenzaA__ABU92826

SEQ ID NO: 76955 - RNA, 1410 nt, Artificial Sequence; identical to SEQ ID NO: 75233
  derived and/or modified sequence opt1 from neuraminidase__InfluenzaA__ABU92827

SEQ ID NO: 76956 - RNA, 1410 nt, Artificial Sequence; identical to SEQ ID NO: 75233
  derived and/or modified sequence opt1 from neuraminidase__InfluenzaA__ABU92828

SEQ ID NO: 76957 - RNA, 1410 nt, Artificial Sequence; identical to SEQ ID NO: 75722
  derived and/or modified sequence opt1 from neuraminidase__InfluenzaA__ABU92829

SEQ ID NO: 76958 - RNA, 1410 nt, Artificial Sequence
  derived and/or modified sequence opt1 from neuraminidase__InfluenzaA__ABU92830
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccgcugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 76959 - RNA, 1410 nt, Artificial Sequence; identical to SEQ ID NO: 75233
  derived and/or modified sequence opt1 from neuraminidase__InfluenzaA__ABU92831

SEQ ID NO: 76960 - RNA, 1410 nt, Artificial Sequence; identical to SEQ ID NO: 75233
  derived and/or modified sequence opt1 from neuraminidase__InfluenzaA__ABU92832

SEQ ID NO: 76961 - RNA, 1410 nt, Artificial Sequence; identical to SEQ ID NO: 75233
  derived and/or modified sequence opt1 from neuraminidase__InfluenzaA__ABU92833

SEQ ID NO: 76962 - RNA, 1410 nt, Artificial Sequence
  derived and/or modified sequence opt1 from neuraminidase__InfluenzaA__ABU92834
augaaccccaaccagaagaucaucaccaucggcagcgugucccugaccaucgccgccaucugcuuccucaugcacaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucucccugaugcccaucuga

SEQ ID NO: 76963 - RNA, 1410 nt, Artificial Sequence; identical to SEQ ID NO: 75233
  derived and/or modified sequence opt1 from neuraminidase__InfluenzaA__ABU92835

SEQ ID NO: 76964 - RNA, 1410 nt, Artificial Sequence; identical to SEQ ID NO: 75233
  derived and/or modified sequence opt1 from neuraminidase__InfluenzaA__ABU92836

SEQ ID NO: 76965 - RNA, 1410 nt, Artificial Sequence
  derived and/or modified sequence opt1 from neuraminidase__InfluenzaA__ABU92837
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgccagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcgucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76966 - RNA, 1410 nt, Artificial Sequence; identical to SEQ ID NO: 75233
  derived and/or modified sequence opt1 from neuraminidase__InfluenzaA__ABU92838

SEQ ID NO: 76967 - RNA, 1410 nt, Artificial Sequence; identical to SEQ ID NO: 75069
  derived and/or modified sequence opt1 from neuraminidase__InfluenzaA__ABU92839

SEQ ID NO: 76968 - RNA, 1410 nt, Artificial Sequence
  derived and/or modified sequence opt1 from neuraminidase__InfluenzaA__ABU92840
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccgggacaaccgguccggcuacagcgggaucuucuccgucgagggcaagagcugcaucaaccgcugcuucuacguggagcugauccggggccgcaagcaggagaccgaggugcucuggacgagcaacuccaucgucguguucugcgggaccagcggcaccuacgggaccggcuccuggccggacggggccgacaucaaccugaugcccaucuga

SEQ ID NO: 76969 - RNA, 1410 nt, Artificial Sequence
  derived and/or modified sequence opt1 from neuraminidase__InfluenzaA__ABU92841
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccgggacaaccgguccggcuacagcgggaucuucuccgucgagggcaagagcugcaucaaccgcugcuucuacguggagcugauccggggccgcaagcaggagaccgaggugcucuggaccagcaacuccaucgucguguucugcgggaccagcggcaccuacgggacgggcuccuggccggacggggccgacaucaaccugaugcccaucuga

SEQ ID NO: 76970 - RNA, 1410 nt, Artificial Sequence
  derived and/or modified sequence opt1 from neuraminidase__InfluenzaA__ABU92842
augaaccccaaccagaagaucaucaccaucggcagcgugucccugaccaucgccacgaucugcuuccucaugcagaucgccauccuggucaccaccgugacccugcacuucaagcaguacgacugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 76971 - RNA, 1410 nt, Artificial Sequence; identical to SEQ ID NO: 75069
  derived and/or modified sequence opt1 from neuraminidase__InfluenzaA__ABU92843

SEQ ID NO: 76972 - RNA, 1410 nt, Artificial Sequence; identical to SEQ ID NO: 76757
  derived and/or modified sequence opt1 from neuraminidase__InfluenzaA__ABU92844

SEQ ID NO: 76973 - RNA, 1410 nt, Artificial Sequence; identical to SEQ ID NO: 75069
  derived and/or modified sequence opt1 from neuraminidase__InfluenzaA__ABU92845

SEQ ID NO: 76974 - RNA, 1410 nt, Artificial Sequence; identical to SEQ ID NO: 75069
  derived and/or modified sequence opt1 from neuraminidase__InfluenzaA__ABU92846

SEQ ID NO: 76975 - RNA, 1410 nt, Artificial Sequence; identical to SEQ ID NO: 75069
  derived and/or modified sequence opt1 from neuraminidase__InfluenzaA__ABU92847

SEQ ID NO: 76976 - RNA, 1410 nt, Artificial Sequence; identical to SEQ ID NO: 75069
  derived and/or modified sequence opt1 from neuraminidase__InfluenzaA__ABU92848

SEQ ID NO: 76977 - RNA, 1410 nt, Artificial Sequence; identical to SEQ ID NO: 75722
  derived and/or modified sequence opt1 from neuraminidase__InfluenzaA__ABU92849

SEQ ID NO: 76978 - RNA, 1410 nt, Artificial Sequence
  derived and/or modified sequence opt1 from neuraminidase__InfluenzaA__ABU92850
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggucgaguaccggaacuggagcaagccgcagugcgacaucaccggguucgcccccuucuccaaggacaacagcauccgccuguccgcgggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugacggagcugggcgugcccuuccaccugggcaccaagcaggucugcaucgccuggagcuccagcuccugccacgacgggaaggccuggcuccacgugugcgugaccggcgacgacaagaacgccaccgcgagcuucaucuacaacgggcgccuggucgacuccaucgugagcugguccaagaagauccugcggacgcaggagagcgagugcgugugcaucaacgggaccugcaccgucgugaugaccgacggguccgccagcggcaaggccgacacgaagauccucuucaucgaggagggcaagaucgugcacaccagcacccuguccgggagcgcccagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcggccacggggugaagggcugggcguucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaacgagguccuguggaccuccaacagcaucgugguguucugcggcaccuccgggacguacggcaccgggagcuggccggacggcgccgacaucaaccugaugcccaucuga

SEQ ID NO: 76979 - RNA, 1410 nt, Artificial Sequence
  derived and/or modified sequence opt1 from neuraminidase__InfluenzaA__ABU92851
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcuccaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaaggacgacagcuccagcuccagccacugccucgaccccaacaacgaggagggcgggcacggggucaagggcugggccuucgacgacgggaacgacguguggaugggccggaccaucuccgagaagucccgcagcggcuacgagaccuucaaggucaucgagggguggagcaaccccaacuccaagcugcagaucaaccgccaggugaucguggaccggggcaaccggagcggguacagcggcaucuucuccgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 76980 - RNA, 1410 nt, Artificial Sequence; identical to SEQ ID NO: 75233
  derived and/or modified sequence opt1 from neuraminidase__InfluenzaA__ABU92852

SEQ ID NO: 76981 - RNA, 1410 nt, Artificial Sequence
  derived and/or modified sequence opt1 from neuraminidase__InfluenzaA__ABU92853
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaagaaccaggugaugcucugcgagcccaccaucaucgagcgcaacaucacggagaucgucuacaugaccaacaccaccaucgagaaggagaucugccccaagcuggccgaguaccggaacugguccaagccgcagugcaacaucacgggguucgcccccuucagcaaggacaacuccauccgccugagcgccggcggggacaucugggugacccgggagcccuacguguccugcgaccccgacaagugcuaccaguucgcccucggccaggggaccacccugaacaacggccacagcaacgacacgguccacgaccgcaccccguaccggacccugcucaugaacgagcugggcgugcccuuccaccuggggacccgccaggugugcaucgcgugguccagcuccagcugccacgacggcaaggccuggcuccacgucugcgugacgggggacgacaagaacgccaccgccuccuucaucuacaacggccggcugguggacagcaucgucuccuggagcaagaagauccugcgcacccaggaguccgagugcgugugcaucaacgggaccugcacgguggucaugaccgacggcagcgcguccggcaaggccgacaccaagauccucuucaucgaggaggggaagaucgugcacaucagcacccugagcggcuccgcccagcacguggaggagugcagcugcuacccccgguaccccgggguccgcugcgugugccgggacaacuggaagggcuccaaccgcccgaucguggacaucaacgucaaggacuacagcaucguguccagcuacgugugcuccggccuggucggggacacgccccggaagaacgacagcuucuccagcucccacugccucgaccccaacaacgaggagggcgggcacggcgugaaggggugggccuucgacgacggcaacgacgucuggaugggccgcaccaucagcgagaagcugcgguccggguacgagaccuucaaggugaucgagggcuggagcaagcccaacuccaagcugcagaucaaccgccaggugaucgucgagcgggggaaccgcagcggcuacuccgggaucuucagcguggagggcaaguccugcaucaaccggugcuucuacguggagcucauccgcggccggaaggaggagaccgaggucugguggacgagcaacagcaucgugguguucugcgggaccuccggcaccuacgggaccggcagcuggccggacggggccgacaucaaccugaugcccaucuga

SEQ ID NO: 76982 - RNA, 1410 nt, Artificial Sequence; identical to SEQ ID NO: 75233
  derived and/or modified sequence opt1 from neuraminidase__InfluenzaA__ABU92854

SEQ ID NO: 76983 - RNA, 1410 nt, Artificial Sequence
  derived and/or modified sequence opt1 from neuraminidase__InfluenzaA__ABU92855
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucaucgagcggggcaaccgcagcggguacuccggcaucuucagcguggagggcaaguccugcaucaaccggugcuucuacgucgagcugauccgcgggcggaaggaggagaccgaggugugguggacgagcaacagcaucguggucuucugcggcaccuccgggaccuacggcaccgggagcuggccggacggcgccgacaucaaccugaugcccaucuga

SEQ ID NO: 76984 - RNA, 1410 nt, Artificial Sequence; identical to SEQ ID NO: 75153
  derived and/or modified sequence opt1 from neuraminidase__InfluenzaA__ABU92856

SEQ ID NO: 76985 - RNA, 1410 nt, Artificial Sequence; identical to SEQ ID NO: 75233
  derived and/or modified sequence opt1 from neuraminidase__InfluenzaA__ABU92857

SEQ ID NO: 76986 - RNA, 1410 nt, Artificial Sequence
  derived and/or modified sequence opt1 from neuraminidase__InfluenzaA__ABU92858
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 76987 - RNA, 1410 nt, Artificial Sequence
  derived and/or modified sequence opt1 from neuraminidase__InfluenzaA__ABU92859
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccggguaccggaacugguccaagccgcagugcaacaucacgggcuucgcccccuucagcaaggacaacuccauccgccucagcgccgggggcgacaucugggugacccgggagcccuacguguccugcgaccccgacaagugcuaccaguucgcccuggggcagggcaccacccugaacaacggccacagcaacgacacgguccacgaccgcaccccguaccggacccuccugaugaacgagcugggggugcccuuccaccucggcacccgccaggugugcaucgcgugguccagcuccagcugccacgacgggaaggccuggcugcacgucugcgugacgggcgacgacaagaacgccaccgccuccuucaucuacaacgggcggcugguggacagcaucggcuccuggagcaagaagauccuccgcacccaggaguccgagugcgucugcaucaacgggaccugcacgguggugaugaccgacggcagcgcguccggcaaggccgacaccaagauccuguucaucgaggaggggaagaucguccacaucagcacccugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggacgagcaacagcaucgucguguucugcgggaccuccggcaccuacgggaccggcagcuggccggacggcgccgacaucaaccugaugcccaucuga

SEQ ID NO: 76988 - RNA, 1410 nt, Artificial Sequence
  derived and/or modified sequence opt1 from neuraminidase__InfluenzaA__ABU92860
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccugguacaagaagauccuccgcacccaggagagcgagugcgucugcaucaacgggaccugcacgguggugaugaccgacggcuccgcgagcgggaaggccgacaccaagauccuguucaucgaggagggcaagaucguccacaucuccacccugagcgggagcgcccagcacguggaggagugcuccugcuacccccgguaccccggcgugcgcugcgucugccgggacaacuggaagggcagcaaccgcccgaucguggacaucaacgugaaggacuacuccaucaucagcuccuacgucugcagcgggcucgugggcgacacgccccggaagaacgacuccuucagcuccagccacugccuggaccccaacaacgaggagggcggccacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcggggcaaccgcuccggguacagcggcaucuucuccguggagggcaagagcugcaucaaccggugcuucuacgucgagcugauccgcgggcggaaggaggagaccgaggugugguggacguccaacagcaucguggucuucugcggcaccagcgggaccuacggcaccggguccuggccggacggcgccgacaucaaccugaugcccaucuga

SEQ ID NO: 76989 - RNA, 1410 nt, Artificial Sequence
  derived and/or modified sequence opt1 from neuraminidase__InfluenzaA__ABU92861
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcauggcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 76990 - RNA, 1410 nt, Artificial Sequence
  derived and/or modified sequence opt1 from neuraminidase__InfluenzaA__ABU92862
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagccgcgacaacuccauccggcucagcgccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccggacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 76991 - RNA, 1410 nt, Artificial Sequence; identical to SEQ ID NO: 75233
  derived and/or modified sequence opt1 from neuraminidase__InfluenzaA__ABU92863

SEQ ID NO: 76992 - RNA, 1410 nt, Artificial Sequence
  derived and/or modified sequence opt1 from neuraminidase__InfluenzaA__ABU92865
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccucgacaagugcuaccaguucgcccugggccaggggaccacgcugaacaacgugcacuccaacgacaccguccacgaccgcacccccuaccggacccuccugaugaacgagcugggcgugccguuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaagaagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcagcggccucgugggcgacaccccgcgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggcccgacggcgccgacaucaaccucaugccgaucuga

SEQ ID NO: 76993 - RNA, 1410 nt, Artificial Sequence
  derived and/or modified sequence opt1 from neuraminidase__InfluenzaA__ABU92866
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccaacagccacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagaccgagguccuguggaccagcaacuccaucgugguguucugcggcaccagcgggacguacggcaccggguccuggccggacggcgccgacaucaaccugaugcccaucuga

SEQ ID NO: 76994 - RNA, 1410 nt, Artificial Sequence; identical to SEQ ID NO: 75815
  derived and/or modified sequence opt1 from neuraminidase__InfluenzaA__ABU92867

SEQ ID NO: 76995 - RNA, 1410 nt, Artificial Sequence; identical to SEQ ID NO: 76922
  derived and/or modified sequence opt1 from neuraminidase__InfluenzaA__ABU92868

SEQ ID NO: 76996 - RNA, 1410 nt, Artificial Sequence; identical to SEQ ID NO: 75702
  derived and/or modified sequence opt1 from neuraminidase__InfluenzaA__ABU92869

SEQ ID NO: 76997 - RNA, 1410 nt, Artificial Sequence; identical to SEQ ID NO: 76892
  derived and/or modified sequence opt1 from neuraminidase__InfluenzaA__ABU92870

SEQ ID NO: 76998 - RNA, 1410 nt, Artificial Sequence
  derived and/or modified sequence opt1 from neuraminidase__InfluenzaA__ABU92872
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacaacaucgucagcuccuacgugugcagcgggcucgugggcgacacgccccggaagaacgacuccuucagcuccagccacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggacguccaacagcaucgucguguucugcggcaccagcgggaccuacggcaccggguccuggccggacggcgccgacaucaaccugaugcccaucuga

SEQ ID NO: 76999 - RNA, 1410 nt, Artificial Sequence
  derived and/or modified sequence opt1 from neuraminidase__InfluenzaA__ABU92873
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaacaucaugcccaucuga

SEQ ID NO: 77000 - RNA, 1410 nt, Artificial Sequence; identical to SEQ ID NO: 76937
  derived and/or modified sequence opt1 from neuraminidase__InfluenzaA__ABU92874

SEQ ID NO: 77001 - RNA, 1410 nt, Artificial Sequence; identical to SEQ ID NO: 75233
  derived and/or modified sequence opt1 from neuraminidase__InfluenzaA__ABU92875

SEQ ID NO: 77002 - RNA, 1410 nt, Artificial Sequence; identical to SEQ ID NO: 75233
  derived and/or modified sequence opt1 from neuraminidase__InfluenzaA__ABU92876

SEQ ID NO: 77003 - RNA, 1410 nt, Artificial Sequence; identical to SEQ ID NO: 75153
  derived and/or modified sequence opt1 from neuraminidase__InfluenzaA__ABU92877

SEQ ID NO: 77004 - RNA, 1410 nt, Artificial Sequence; identical to SEQ ID NO: 75233
  derived and/or modified sequence opt1 from neuraminidase__InfluenzaA__ABU92878

SEQ ID NO: 77005 - RNA, 1410 nt, Artificial Sequence
  derived and/or modified sequence opt1 from neuraminidase__InfluenzaA__ABU92879
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaagggcgagaccgaggugugguggaccagcaacagcaucgucguguucugcgggaccuccggcaccuacgggacgggcagcuggccggacggcgccgacaucaaccugaugcccaucuga

SEQ ID NO: 77006 - RNA, 1410 nt, Artificial Sequence; identical to SEQ ID NO: 76998
  derived and/or modified sequence opt1 from neuraminidase__InfluenzaA__ABU92880

SEQ ID NO: 77007 - RNA, 1410 nt, Artificial Sequence; identical to SEQ ID NO: 75233
  derived and/or modified sequence opt1 from neuraminidase__InfluenzaA__ABU92881

SEQ ID NO: 77008 - RNA, 1410 nt, Artificial Sequence; identical to SEQ ID NO: 75233
  derived and/or modified sequence opt1 from neuraminidase__InfluenzaA__ABU92882

SEQ ID NO: 77009 - RNA, 1410 nt, Artificial Sequence
  derived and/or modified sequence opt1 from neuraminidase__InfluenzaA__ABU92883
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaagaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucgucuccuggagcaagaagauccuccgcacccaggaguccgagugcgugugcaucaacgggaccugcacgguggucaugaccgacggcagcgcguccggcaaggccgacaccaagauccuguucaucgaggaggggaagaucgugcacaucagcacccugagcggcuccgcccagcacguggaggagugcagcugcuacccccgguaccccgggguccgcugcgugugccgggacaacuggaagggcuccaaccgcccgaucguggacaucaacgucaaggacuacagcaucguguccagcuacgugugcuccggccucgucggggacacgccccggaagaacgacagcuucuccagcucccacugccuggaccccaacaacgaggagggcgggcacggcgugaaggggugggccuucgacgacggcaacgacgucuggaugggccgcaccaucagcgagaagcugcgguccggguacgagaccuucaaggugaucgagggcuggagcaagcccaacuccaagcuccagaucaaccgccaggugaucgucgagcgggggaaccgcagcggcuacuccgggaucuucagcguggagggcaaguccugcaucaaccggugcuucuacguggagcugauccgcggccggaaggaggagaccgaggucugguggacgagcaacagcaucgugguguucugcgggaccuccggcaccuacgggaccggcagcuggccggacggggccgacaucaaccugaugcccaucuga

SEQ ID NO: 77010 - RNA, 1410 nt, Artificial Sequence; identical to SEQ ID NO: 75233
  derived and/or modified sequence opt1 from neuraminidase__InfluenzaA__ABU92884

SEQ ID NO: 77011 - RNA, 1410 nt, Artificial Sequence; identical to SEQ ID NO: 75233
  derived and/or modified sequence opt1 from neuraminidase__InfluenzaA__ABU92885

SEQ ID NO: 77012 - RNA, 1410 nt, Artificial Sequence; identical to SEQ ID NO: 75722
  derived and/or modified sequence opt1 from neuraminidase__InfluenzaA__ABU92886

SEQ ID NO: 77013 - RNA, 1410 nt, Artificial Sequence; identical to SEQ ID NO: 75233
  derived and/or modified sequence opt1 from neuraminidase__InfluenzaA__ABU92887

SEQ ID NO: 77014 - RNA, 1410 nt, Artificial Sequence
  derived and/or modified sequence opt1 from neuraminidase__InfluenzaA__ABU92888
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucaucagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaagguggucgagggguggagcaaccccaacuccaagcugcagaucaaccgccaggugaucguggaccgggacaaccggagcggcuacuccgggaucuucagcgucgagggcaagagcugcaucaaccgcugcuucuacguggagcucauccgggggcgcaaccaggagaccgaggugcuguggaccuccaacagcaucgucguguucugcggcaccuccggcacguacgggaccggcagcuggccggacggggccgacaucaaccugaugcccaucuga

SEQ ID NO: 77015 - RNA, 1410 nt, Artificial Sequence; identical to SEQ ID NO: 76937
  derived and/or modified sequence opt1 from neuraminidase__InfluenzaA__ABU92889

SEQ ID NO: 77016 - RNA, 1410 nt, Artificial Sequence
  derived and/or modified sequence opt1 from neuraminidase__InfluenzaA__ABU92890
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcuggugcgcgggcggaaggaggagaccgaggucugguggacgagcaacagcaucgugguguucugcggcaccuccgggaccuacggcaccgggagcuggccggacggcgccgacaucaaccugaugcccaucuga

SEQ ID NO: 77017 - RNA, 1410 nt, Artificial Sequence; identical to SEQ ID NO: 76953
  derived and/or modified sequence opt1 from neuraminidase__InfluenzaA__ABU92891

SEQ ID NO: 77018 - RNA, 1410 nt, Artificial Sequence
  derived and/or modified sequence opt1 from neuraminidase__InfluenzaA__ABU92892
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcgggaacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77019 - RNA, 1410 nt, Artificial Sequence; identical to SEQ ID NO: 75815
  derived and/or modified sequence opt1 from neuraminidase__InfluenzaA__ABU92893

SEQ ID NO: 77020 - RNA, 1410 nt, Artificial Sequence
  derived and/or modified sequence opt1 from neuraminidase__InfluenzaA__ABU92895
augaaccccaaccagaagaucaucaccgugggcagcgucucccugaccaucagcacgaucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgccagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77021 - RNA, 1410 nt, Artificial Sequence
  derived and/or modified sequence opt1 from neuraminidase__InfluenzaA__ABU92896
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcaacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgaccgcaacgacgucuggauggggcggaccaucagcgagaagucccgccugggcuacgagaccuucaaggugaucgagggcuggagcaaccccaacuccaagcugcagaucaaccggcaggucaucguggaccgcgggaaccggagcggcuacuccgggaucuucagcguggagggcaagagcugcaucaaccgcugcuucuacgucgagcucauccgggggcgcaaggaggagaccgaggugcuguggaccuccaacagcaucguggucuucugcggcaccuccggcacguacgggaccggcagcuggccggacggggccgacaucaaccugaugcccaucuga

SEQ ID NO: 77022 - RNA, 1410 nt, Artificial Sequence
  derived and/or modified sequence opt1 from neuraminidase__InfluenzaA__ABU92897
augaaccccaaccagaagaucaucaccaucggcagcgugucccugaccaucagcacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcaacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccucgugggcgacacgccccgcaagaacgacuccagcuccagcucccacugccuggaccccaacaacgaggagggcgggcacggggucaagggcugggccuucgacgacgggaacgacguguggaugggccggaccaucagcgagaagucccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 77023 - RNA, 1410 nt, Artificial Sequence
  derived and/or modified sequence opt1 from neuraminidase__InfluenzaA__ABU92898
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccggaccggguacuccggcaucuucagcguggaggggaaguccugcaucaaccgcugcuucuacguggagcugauccggggccgcaaggaggagaccgagguccuguggacgagcaacagcaucgugguguucugcggcaccuccgggaccuacggcaccgggagcuggccggacggcgccgacaucaaccucaugcccaucuga

SEQ ID NO: 77024 - RNA, 1410 nt, Artificial Sequence; identical to SEQ ID NO: 75233
  derived and/or modified sequence opt1 from neuraminidase__InfluenzaA__ABU92899

SEQ ID NO: 77025 - RNA, 1410 nt, Artificial Sequence
  derived and/or modified sequence opt1 from neuraminidase__InfluenzaA__ABU92900
augaaccccaaccagaagaucaucaccaucggcagcgugucccugaccaucgccgccaucugcuuccucaugcagaucgcgauccuggucacgaccgugacccugcacuucaagcagcacgagugcaacccgccgcccaacaaccaggugaugcucugcgagcccaccaucaucgagcgcaacaucacggagaucgucuaccugaccaacaccaccaucgagaaggagaucugccccaagcuggccgaguaccggaacuggagcaagccccagugcaacaucacgggguucgcccccuucuccaaggacaacagcauccgccucuccgccggcggggacaucugggugacccgggagcccuacgugagcugcgacccggacaagugcuaccaguucgcccugggccaggggaccacccugaacaacggccacuccaacgacacgguccacgaccgcacccccuaccggacccuccugaugaacgagcugggcgugcccuuccaccucgggacccgccaggugugcaucgcguggagcuccagcuccugccacgacggcaaggccuggcugcacgucugcgugacgggggacgacaagaacgccaccgccagcuucaucuacaacggccggcugguggacuccaucgggagcugguccaagaagauccuccgcacccaggagagcgagugcgucugcaucaacgggaccugcacgguggugaugaccgacggcuccgcgagcgggaaggccgacaccaagauccuguucaucgaggagggcaagaucguccacaucuccacccugagcgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagccgaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggacguccaacagcaucgucguguucugcggcaccagcgggaccuacggcaccggguccuggcccgacggcgccgacaucaaccugaugcccaucuga

SEQ ID NO: 77026 - RNA, 1410 nt, Artificial Sequence
  derived and/or modified sequence opt1 from neuraminidase__InfluenzaA__ABU92901
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucuccagcugguccaagaagauccuccgcacccaggagagcgagugcgucugcaucaacgggaccugcacgguggugaugaccgacggcuccgcgagcggcaaggccgacaccaagauccuguucaucgaggaggggaagaucguccacaucagcacccuguccggcagcgcccagcacguggaggagugcuccugcuacccccgguaccccggggugcgcugcgucugccgggacaacuggaagggcagcaaccgcccgaucguggacaucaacgugaaggacuacuccaucgucagcuccuacgugugcagcggccucgugggggacacgccccggaagaacgacuccuucagcuccagccacugccuggaccccaacaacgaggagggcgggcacggcgucaaggggugggccuucgacgacggcaacgacguguggaugggccgcaccaucuccgagaagcugcggagcggguacgagaccuucaaggucaucgagggcugguccaagcccaacagcaagcuccagaucaaccgccaggugaucguggagcgggggaaccgcuccggcuacagcgggaucuucuccgucgagggcaagagcugcaucaaccggugcuucuacguggagcugauccgcggccggaaggaggagaccgaggugugguggacgagcaacuccaucgucguguucugcgggaccagcggcaccuacgggaccggcuccuggccggacggggccgacaucaaccugaugcccaucuga

SEQ ID NO: 77027 - RNA, 1410 nt, Artificial Sequence; identical to SEQ ID NO: 75233
  derived and/or modified sequence opt1 from neuraminidase__InfluenzaA__ABU92902

SEQ ID NO: 77028 - RNA, 1410 nt, Artificial Sequence; identical to SEQ ID NO: 75233
  derived and/or modified sequence opt1 from neuraminidase__InfluenzaA__ABU92903

SEQ ID NO: 77029 - RNA, 1410 nt, Artificial Sequence; identical to SEQ ID NO: 76188
  derived and/or modified sequence opt1 from neuraminidase__InfluenzaA__ABU92904

SEQ ID NO: 77030 - RNA, 1410 nt, Artificial Sequence; identical to SEQ ID NO: 75233
  derived and/or modified sequence opt1 from neuraminidase__InfluenzaA__ABU92905

SEQ ID NO: 77031 - RNA, 1410 nt, Artificial Sequence
  derived and/or modified sequence opt1 from neuraminidase__InfluenzaA__ABU92906
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaagcugaugcccaucuga

SEQ ID NO: 77032 - RNA, 1410 nt, Artificial Sequence
  derived and/or modified sequence opt1 from neuraminidase__InfluenzaA__ABU92907
augaaccccaaccagaagaucaucaccaucggcagcaucucccugaccaucgccgccaucugcuuccucaugcagaucgcgauccuggugacgaccgucacccugcacuucaagcagcacgagugcaacagcccgcccaacaaccaggugaugcucugcgagcccaccaucaucgagcgcaacaucacggagaucguguaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggucacccgggagcccuacguguccugcgaccccgacaagugcuaccaguucgcccugggccaggggaccacccugaacaacggccacagcaacgacacggugcacgaccgcaccccguaccggacccuccugaugaacgagcugggcguccccuuccaccucgggacccgccaggugugcaucgcgugguccagcuccagcugccacgacggcaaggccuggcugcacgugugcgucacgggggacgacaagaacgccaccgccuccuucaucuacaacggccggcugguggacagcaucggguccuggagcaagaagauccuccgcacccaggaguccgagugcgugugcaucaacgggaccugcacggucgugaugaccgacggcagcgcguccgggaaggccgacaccaagauccuguucaucgaggagggcaagaucgugcacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggacgagcaacagcaucguggucuucugcggcaccuccgggaccuacggcaccgggagcuggccggacggcgccgacaucaaccugaugcccaucuga

SEQ ID NO: 77033 - RNA, 1410 nt, Artificial Sequence; identical to SEQ ID NO: 75233
  derived and/or modified sequence opt1 from neuraminidase__InfluenzaA__ABU92908

SEQ ID NO: 77034 - RNA, 1410 nt, Artificial Sequence; identical to SEQ ID NO: 75233
  derived and/or modified sequence opt1 from neuraminidase__InfluenzaA__ABU92909

SEQ ID NO: 77035 - RNA, 1410 nt, Artificial Sequence
  derived and/or modified sequence opt1 from neuraminidase__InfluenzaA__ABU92910
augaaccccaaccagaagaucaucaccaucggcagcgugucccugaccaucgccacgaucugcuuccucacccagaucgccauccugaucaccaccgucacgcugcacuucaagcaguacgagugcaacagcccgcccaacaaccaggugaugcucugcgagcccaccaucaucgagcgcaacaucaccgagaucguguaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggacgacccugaacaacggccacagcaacgacaccgugcacgaccgcaccccguaccggacgcuccugaugaacgagcugggcguccccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgugugcaucaacgggaccugcaccgucgugaugaccgacggcagcgccuccgggaaggcggacacgaagauccuguucaucgaggagggcaagaucgugcacaccagccugcucagcggguccgcccagcacgucgaggagugcagcugcuacccccgcuaccccggcgugcggugcgugugccgcgacaacuggaagggcuccaaccggccgaucgucgacaucaacgugcgcgacuacagcaucguguccagcuacgucugcuccgggcuggugggcgacacgccccggaagaacgacagcuccagcuccagccacugccuggaccccaacaacgaggagggcggccacggggugaagggcugggccuucgacgacggcaacgacgucuggauggggcgcaccaucuccgagaagcuccggagcggcuacgagaccuucaaggugaucgaggggugguccaagcccaacagcaagcugcagaucaaccgccaggucaucguggacaagggcaaccgguccggguacagcggcaucuucuccguggagggcaagagcugcaucaaccgcugcuucuacgucgagcugauccgggggcgcaaccaggagaccgaggugcucuggaccagcaacuccaucguggucuucugcggcaccagcgggacguacggcaccggguccuggccggacggcgccgacaucaaccugaugcccaucuga

SEQ ID NO: 77036 - RNA, 1410 nt, Artificial Sequence
  derived and/or modified sequence opt1 from neuraminidase__InfluenzaA__ABU92911
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcaggcggaguaccggaacugguccaagccgcagugcaacaucaccggguucgcccccuucagcaaggacaacuccauccgccugagcgccggcggggacaucugggugacccgggagcccuacguguccugcgaccccgacaagugcuaccaguucgcccucggccaggggacgacccugaacaacggccacagcaacgacaccguccacgaccgcaccccguaccggacgcugcucaugaacgagcugggcgugcccuuccaccuggggaccaagcaggucugcaucgccugguccagcuccagcugccacgacggcaaggcguggcuccacgugugcgugaccggggacgacaagaacgccaccgccuccuucaucuacaacggccgccugguggacagcaucggguccuggagcaagaagauccugcggacgcaggaguccgagugcgucugcaucaacgggaccugcaccguggugaugaccgacggcagcgccuccgggaaggcggacacgaagauccucuucaucaaggagggcaagaucguccacaccagccugcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuccagcuccagccacugccuggaccccaacaacgaggagggcggccacggggucaagggcugggccuucgacgacggcaacgacguguggauggggcggaccaucuccgagaagcugcgcagcggcuacgagaccuucaaggucaucgaggggugguccaagcccaacagcaagcuccagaucaaccgccaggugaucguggaccgggacaaccgguccggcuacagcgggaucuucuccgucgagggcaagagcugcaucaaccgcugcuucuacguggagcugauccggggccgcaaccaggagaccgaggugcuguggaccagcaacuccaucgucguguucugcgggaccagcggcacguacgggaccggcuccuggccggacggggccgacaucaaccucaugcccaucuga

SEQ ID NO: 77037 - RNA, 1410 nt, Artificial Sequence
  derived and/or modified sequence opt1 from neuraminidase__InfluenzaA__ABU92913
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucaaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccgggacaaccgguccggcuacagcgggaucuucuccgucgagggcaagagcugcaucaaccgcugcuucuacguggagcugauccggggccgcaaccaggagaccgaggugcucuggaccagcaacuccaucgucguguucugcgggaccagcggcacguacgggaccggcuccuggccggacggggccgacaucaaccugaugcccaucuga

SEQ ID NO: 77038 - RNA, 1413 nt, Artificial Sequence
  derived and/or modified sequence opt1 from neuraminidase__InfluenzaA__ABV29560
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77039 - RNA, 1413 nt, Artificial Sequence; identical to SEQ ID NO: 77038
  derived and/or modified sequence opt1 from neuraminidase__InfluenzaA__ABV29571

SEQ ID NO: 77040 - RNA, 1413 nt, Artificial Sequence; identical to SEQ ID NO: 77038
  derived and/or modified sequence opt1 from neuraminidase__InfluenzaA__ABV29582

SEQ ID NO: 77041 - RNA, 1413 nt, Artificial Sequence; identical to SEQ ID NO: 77038
  derived and/or modified sequence opt1 from neuraminidase__InfluenzaA__ABV29615

SEQ ID NO: 77042 - RNA, 1413 nt, Artificial Sequence
  derived and/or modified sequence opt1 from neuraminidase__InfluenzaA__ABV29637
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcaccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugaccgucgacggcgccgacggggugaagggcuucagcuacaaguacggcaacgggguguggaucggccggaccaaguccaacaagcugcgcaagggguucgagaugaucugggaccccaacggcuggaccgacacggacagcgacuucuccgucaagcaggacgugguggcgaucagcgacuggagcggguacuccggcagcuucguccagcaccccgagcucaccggccuggacugcauccggcccugcuucuggguggagcugguccgcgggcucccgcgggagaacaccaccaucuggacguccggcagcuccaucagcuucugcgggguggacuccgacaccgccaacuggagcuggcccgacggcgccgagcugcccuucaccaucgacaaguga

SEQ ID NO: 77043 - RNA, 1413 nt, Artificial Sequence; identical to SEQ ID NO: 77038
  derived and/or modified sequence opt1 from neuraminidase__InfluenzaA__ABV29648

SEQ ID NO: 77044 - RNA, 1413 nt, Artificial Sequence; identical to SEQ ID NO: 77038
  derived and/or modified sequence opt1 from neuraminidase__InfluenzaA__ABV29659

SEQ ID NO: 77045 - RNA, 1413 nt, Artificial Sequence; identical to SEQ ID NO: 77038
  derived and/or modified sequence opt1 from neuraminidase__InfluenzaA__ABV29670

SEQ ID NO: 77046 - RNA, 1413 nt, Artificial Sequence
  derived and/or modified sequence opt1 from neuraminidase__InfluenzaA__ABV29681
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggaucgacuccgacaccgccaacuggagcuggcccgacggcgccgagcugcccuucaccaucgacaaguga

SEQ ID NO: 77047 - RNA, 1413 nt, Artificial Sequence; identical to SEQ ID NO: 77038
  derived and/or modified sequence opt1 from neuraminidase__InfluenzaA__ABV29692

SEQ ID NO: 77048 - RNA, 1413 nt, Artificial Sequence; identical to SEQ ID NO: 77038
  derived and/or modified sequence opt1 from neuraminidase__InfluenzaA__ABV29703

SEQ ID NO: 77049 - RNA, 1410 nt, Artificial Sequence
  derived and/or modified sequence opt1 from neuraminidase__InfluenzaA__ABV29714
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77050 - RNA, 1410 nt, Artificial Sequence
  derived and/or modified sequence opt1 from neuraminidase__InfluenzaA__ABV29725
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggggaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacagcauccgccuguccgccgggggcgacaucugggugacccgggagcccuacgucagcugcgaccccgacaagugcuaccaguucgcccucgggcagggcacgacccugaacaacgugcacuccaacgacaccgugcgcgaccggaccccguaccgcacgcugcucaugaacgagcugggcguccccuuccaccuggggaccaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacgcaggagagcgagugcgugugcaucaacgggaccugcaccgucgugaugaccgacggcuccgccagcggcaaggccgacacgaagauccucuucaucgaggaggggaagaucgugcacaccagcacccuguccggcagcgcgcagcacgucgaggagugcuccugcuucccccgguaccccggggugcgcugcgugugccgggacaacuggaagggcagcaaccgcccgaucgucgacaucaacaucaaggaccacuccaucgugagcuccuacgugugcagcggccuggucggggacacgccccggaagaacgacuccagcuccagcucccacugccucgaccccaacaacgaggagggcgggcacggcgugaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucgucgaccgggggaaccgcagcggcuacuccgggaucuucagcguggagggcaagagcugcaucaaccggugcuucuacguggagcucauccgcggccggaaggaggagaccgagguccuguggaccuccaacagcaucgugguguucugcgggacguccggcaccuacgggaccggcagcuggccggacggggccgacaucaaccugaugcccaucuga

SEQ ID NO: 77051 - RNA, 1413 nt, Artificial Sequence
  derived and/or modified sequence opt1 from neuraminidase__InfluenzaA__ABV29736
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacguggugaccgggaaggacaagaccagcgucacccuggcgggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcccccagcccguacaacagcaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcgcauccugcggacccaggagagcgagugcgugugcgugaacggcuccugcuucacgaucaugaccgacgggcccagcgacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgccgacggggugaagggcuucagcuacaaguacggcaacgggguguggaucggccggaccaaguccaacaagcugcgcaagggguucgagaugaucugggaccccaacggcuggaccgacacggacaacgacuucagcgucaagcaggacgugguggcgaucaccgacugguccggguacagcggcagcuucguccagcaccccgagcucaccggccuggacugcauccggcccugcuucuggguggagcugguccgcgggcucccgcgggagaacaccacgaucuggaccuccggcagcuccaucagcuucugcgggguggacuccgacaccgccaacuggagcuggcccgacggcgccgagcugcccuucaccaucgacaaguga

SEQ ID NO: 77052 - RNA, 1413 nt, Artificial Sequence
  derived and/or modified sequence opt1 from neuraminidase__InfluenzaA__ABV29747
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcguccgccaggacgugguggccaucacggacuggagcggguacuccggcagcuucguccagcaccccgagcucaccggccuggacugcauccggcccugcuucuggguggagcugguccgcgggcucccgcgggagaacaccaccaucuggacguccggcagcuccaucagcuucugcgggguggacuccgacaccgccaacuggagcuggcccgacggcgccgagcugcccuucaccaucgacaaguga

SEQ ID NO: 77053 - RNA, 1413 nt, Artificial Sequence; identical to SEQ ID NO: 77038
  derived and/or modified sequence opt1 from neuraminidase__InfluenzaA__ABV29769

SEQ ID NO: 77054 - RNA, 1413 nt, Artificial Sequence
  derived and/or modified sequence opt1 from neuraminidase__InfluenzaA__ABV29780
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacguggugaccgggaaggacaagaccagcgucacccuggcgggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcccccagcccguacaacagcaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcgcauccugcggacccaggagagcgagugcgugugcgugaacggcuccugcuucacgaucaugaccgacgggcccagcgacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgccgacggggugaagggcuucagcuacaaguacggcaacgggguguggaucggccggaccaaguccagcaagcugcgcaagggguucgagaugaucugggaccccaacggcuggaccgacacggacaacgacuucuccgucaagcaggacgugguggcgaucaccgacuggagcggguacagcggcuccuucguccagcaccccgagcucaccggccuggacugcauccggcccugcuucuggguggagcugguccgcgggcucccgcgggagaacaccacgaucuggaccagcggcuccagcaucuccuucugcgggguggacagcgacaccgccaacugguccuggcccgacggcgccgagcugcccuucaccaucgacaaguga

SEQ ID NO: 77055 - RNA, 1413 nt, Artificial Sequence; identical to SEQ ID NO: 77038
  derived and/or modified sequence opt1 from neuraminidase__InfluenzaA__ABV29791

SEQ ID NO: 77056 - RNA, 1413 nt, Artificial Sequence; identical to SEQ ID NO: 77038
  derived and/or modified sequence opt1 from neuraminidase__InfluenzaA__ABV29802

SEQ ID NO: 77057 - RNA, 1410 nt, Artificial Sequence; identical to SEQ ID NO: 76892
  derived and/or modified sequence opt1 from neuraminidase__InfluenzaA__ABV29824

SEQ ID NO: 77058 - RNA, 1413 nt, Artificial Sequence; identical to SEQ ID NO: 77038
  derived and/or modified sequence opt1 from neuraminidase__InfluenzaA__ABV29835

SEQ ID NO: 77059 - RNA, 1413 nt, Artificial Sequence
  derived and/or modified sequence opt1 from neuraminidase__InfluenzaA__ABV29846
augaaccccaaccagaagaucaucaccaucggcagcaucuccaucgccaucgggaucaucagccugaugcuccagaucggcaacaucaucuccaucugggccagccacuccauccagaucgggagccagaaccacaccggcaucugcaaccagcgcaucaucacguacgagaacuccaccugggugaaccacaccuacgucaacaucaacaacaccaacgugguggcggggaaggacaagacgagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugaccgucgacggcgcggacggggugaagggcuucagcuacaaguacggcaacgggguguggaucggccggacgaaguccaacaagcugcgcaagggguucgagaugaucugggaccccaacggcuggaccgacaccgacagcgacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccagcggcuccagcaucuccuucugcgggguggacagcgacacggccaacugguccuggcccgacggcgccgagcugcccuucaccaucgacaaguga

SEQ ID NO: 77060 - RNA, 1413 nt, Artificial Sequence
  derived and/or modified sequence opt1 from neuraminidase__InfluenzaA__ABV29879
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucaucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcgucgccugguccgccagcgccugccacgacggcaugggcuggcucaccaucgggaucuccggccccgacaacggggcgguggccgugcugaaguacaacggcaucaucacggagaccaucaagagcuggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccaucgagcucaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggagcugcaacccggugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77061 - RNA, 1413 nt, Artificial Sequence; identical to SEQ ID NO: 77038
  derived and/or modified sequence opt1 from neuraminidase__InfluenzaA__ABV29890

SEQ ID NO: 77062 - RNA, 1410 nt, Artificial Sequence; identical to SEQ ID NO: 76892
  derived and/or modified sequence opt1 from neuraminidase__InfluenzaA__ABV29901

SEQ ID NO: 77063 - RNA, 1410 nt, Artificial Sequence
  derived and/or modified sequence opt1 from neuraminidase__InfluenzaA__ABV29912
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggacauccugcggacccaggagagcgagugcaucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccggcaggucaucguggacaagggcaaccgcuccggguacagcggcaucuucuccguggagggcaagagcugcaucaaccggugcuucuacgucgagcugauccgcgggcggaaggaggagaccgaggugcuguggaccagcaacuccaucguggucuucugcggcaccagcgggacguacggcaccggguccuggccggacggcgccgacaucaaccucaugcccaucuga

SEQ ID NO: 77064 - RNA, 1413 nt, Artificial Sequence
  derived and/or modified sequence opt1 from neuraminidase__InfluenzaA__ABV29923
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacgccaccaucuggaccagcggcuccagcaucuccuucugcgggguggacagcgacacggccaacugguccuggcccgacggcgccgagcugcccuucaccaucgacaaguga

SEQ ID NO: 77065 - RNA, 1410 nt, Artificial Sequence
  derived and/or modified sequence opt1 from neuraminidase__InfluenzaA__ABV29934
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcaccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgacaucaaccugaugcccaucuga

SEQ ID NO: 77066 - RNA, 1413 nt, Artificial Sequence; identical to SEQ ID NO: 77051
  derived and/or modified sequence opt1 from neuraminidase__InfluenzaA__ABV29945

SEQ ID NO: 77067 - RNA, 1413 nt, Artificial Sequence
  derived and/or modified sequence opt1 from neuraminidase__InfluenzaA__ABV29956
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaagggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77068 - RNA, 1413 nt, Artificial Sequence
  derived and/or modified sequence opt1 from neuraminidase__InfluenzaA__ABV29989
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugaugcgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77069 - RNA, 1413 nt, Artificial Sequence; identical to SEQ ID NO: 77038
  derived and/or modified sequence opt1 from neuraminidase__InfluenzaA__ABV30000

SEQ ID NO: 77070 - RNA, 1413 nt, Artificial Sequence; identical to SEQ ID NO: 77038
  derived and/or modified sequence opt1 from neuraminidase__InfluenzaA__ABV30011

SEQ ID NO: 77071 - RNA, 1413 nt, Artificial Sequence; identical to SEQ ID NO: 77038
  derived and/or modified sequence opt1 from neuraminidase__InfluenzaA__ABV30022

SEQ ID NO: 77072 - RNA, 1413 nt, Artificial Sequence
  derived and/or modified sequence opt1 from neuraminidase__InfluenzaA__ABV30044
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcggcacccuggccggcaacuccagccugugcuccaucagcgggugggccaucuacaccaaggacaacuccauccggaucggcagcaagggggacgucuucgugauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcgcccagcccguacaacagcaaguucgaguccgucgccuggagcgccuccgccugccacgacggcaugggguggcucaccaucggcaucagcgggcccgacaacggcgcgguggccgugcugaaguacaacggcaucaucacggagaccaucaaguccuggaagaagcgcauccugcggacccaggagagcgagugcgucugcgugaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccaggucggcuacaucugcagcgggguguucggcgacaacccccgccccaaggacgggaagggcuccugcaacccgaugacgguggacggggcggacggcgucaagggcuucagcuacaaguacgggaacggcguguggaucgggcggaccaaguccaacaagcugcgcaagggcuucgagaugaucugggaccccaacggguggaccgacaccgacagcgacuucuccgugaagcaggacgucguggccaucacggacuggagcggcuacagcggcuccuucgugcagcaccccgagcucaccgggcuggacugcauccggcccugcuucugggucgagcuggugcgcggccucccgcgggagaacaccaccaucuggacgagcggguccagcaucuccuucugcggcgucgacagcgacaccgccaacugguccuggcccgacggcgccgagcugcccuucaccaucgacaaguga

SEQ ID NO: 77073 - RNA, 1413 nt, Artificial Sequence
  derived and/or modified sequence opt1 from neuraminidase__InfluenzaA__ABV30055
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 77074 - RNA, 1410 nt, Artificial Sequence
  derived and/or modified sequence opt1 from neuraminidase__InfluenzaA__ABV30077
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 77075 - RNA, 1413 nt, Artificial Sequence; identical to SEQ ID NO: 77038
  derived and/or modified sequence opt1 from neuraminidase__InfluenzaA__ABV30088

SEQ ID NO: 77076 - RNA, 1413 nt, Artificial Sequence; identical to SEQ ID NO: 77038
  derived and/or modified sequence opt1 from neuraminidase__InfluenzaA__ABV30099

SEQ ID NO: 77077 - RNA, 1413 nt, Artificial Sequence
  derived and/or modified sequence opt1 from neuraminidase__InfluenzaA__ABV30110
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcgcauccugcggacccaggaguccgagugcgugugcgugaacgggagcugcuucaccaucaugacggacggccccuccaacggggccgccagcuacaagaucuucaagaucgagaagggcaaggucaccaaguccaucgagcucaacgcccccaacuuccacuacgaggagugcagcugcuacccggacaccgggaccgugaugugcgugugccgcgacaacuggcacggcuccaaccggcccugggucagcuucaaccagaaccuggacuaccagaucggcuacaucugcuccgggguguucggcgacaacccccgccccaaggacgggaagggcagcugcaacccggugacggucgacggggcggacggcgugaagggcuucuccuacaaguacgggaacggcguguggaucgggcggaccaagagcaaccgccugcggaagggcuucgagaugaucugggaccccaacggguggaccgacaccgacuccgacuucagcgucaagcaggacgugguggccaucacggacuggagcggcuacuccggcagcuucguccagcaccccgagcucaccgggcuggacugcauccgccccugcuucuggguggagcugguccggggccucccgcgcgagaacaccaccaucuggacguccgggagcuccaucagcuucugcggcguggacuccgacaccgccaacuggagcuggcccgacggcgccgagcugcccuucaccaucgacaaguga

SEQ ID NO: 77078 - RNA, 1413 nt, Artificial Sequence; identical to SEQ ID NO: 77038
  derived and/or modified sequence opt1 from neuraminidase__InfluenzaA__ABV30132

SEQ ID NO: 77079 - RNA, 1413 nt, Artificial Sequence
  derived and/or modified sequence opt1 from neuraminidase__InfluenzaA__ABV30143
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77080 - RNA, 1413 nt, Artificial Sequence; identical to SEQ ID NO: 77064
  derived and/or modified sequence opt1 from neuraminidase__InfluenzaA__ABV30154

SEQ ID NO: 77081 - RNA, 1413 nt, Artificial Sequence
  derived and/or modified sequence opt1 from neuraminidase__InfluenzaA__ABV30165
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaaccugagccucugcuccaucagcggcugggccaucuacaccaaggacaacuccauccggaucgggagcaagggcgacguguucgugauccgcgagccguucaucuccugcagccaccuggagugccggacguucuuccugacccagggggcccuccugaacgacaagcacuccaacggcaccgucaaggaccgcagccccuaccgggcccugauguccugcccccucggggaggcgcccagcccguacaacagcaaguucgaguccguggccuggagcgccuccgccugccacgacggcaugggcuggcugaccaucgggaucagcggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccagcaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacagcgacuucuccgucaagcaggacgugguggccaucacggacuggagcggguacagcggcuccuucguccagcaccccgagcugaccggccuggacugcauccgccccugcuucuggguggagcucguccgggggcugccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77082 - RNA, 1413 nt, Artificial Sequence; identical to SEQ ID NO: 77038
  derived and/or modified sequence opt1 from neuraminidase__InfluenzaA__ABV30187

SEQ ID NO: 77083 - RNA, 1413 nt, Artificial Sequence; identical to SEQ ID NO: 77038
  derived and/or modified sequence opt1 from neuraminidase__InfluenzaA__ABV30198

SEQ ID NO: 77084 - RNA, 1410 nt, Artificial Sequence; identical to SEQ ID NO: 76892
  derived and/or modified sequence opt1 from neuraminidase__InfluenzaA__ABV30209

SEQ ID NO: 77085 - RNA, 1410 nt, Artificial Sequence; identical to SEQ ID NO: 77074
  derived and/or modified sequence opt1 from neuraminidase__InfluenzaA__ABV30220

SEQ ID NO: 77086 - RNA, 1410 nt, Artificial Sequence; identical to SEQ ID NO: 77074
  derived and/or modified sequence opt1 from neuraminidase__InfluenzaA__ABV30231

SEQ ID NO: 77087 - RNA, 1410 nt, Artificial Sequence
  derived and/or modified sequence opt1 from neuraminidase__InfluenzaA__ABV30264
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagguggucuaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggugacccgggagcccuacguguccugcgaccccgacaagugcuaccaguucgcccucggccaggggaccacgcugaacaacguccacagcaacgacaccgugcacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccuggucgacagcaucguguccuggagcaaggagauccugcggacccaggaguccgagugcgugugcaucaacggcacgugcaccgucgugaugaccgacgggagcgccagcggcaaggccgacaccaagauccucuucaucgaggagggcaagaucgugcacacguccacccugagcggguccgcgcagcacgucgaggagugcagcugcuacccccgcuaccccggcgugcggugcgugugccgcgacaacuggaagggguccaaccggccgaucgucgacaucaacaucaaggacuacagcaucgugucccgcuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggagcggcuacgagaccuucaaggugaucgaggggugguccaaccccaacagcaagcugcagaucaaccgccaggugaucgucgaccggggcaaccgcuccggguacagcggcaucuucagcguggaggggaaguccugcaucaaccggugcuucuacguggagcugauccgcggccggaaggaggagaccgagguccucuggaccagcaacuccaucgugguguucugcggcaccagcgggacguacggcaccggguccuggccggacggcgccgacaucaaccugaugcccaucuga

SEQ ID NO: 77088 - RNA, 1410 nt, Artificial Sequence
  derived and/or modified sequence opt1 from neuraminidase__InfluenzaA__ABV30275
augaaccccaaccagaagaucaucaccaucggcagcgugucccugaccaucagcacgaucugcuucuucaugcagaccgccauccucaucaccaccgucacgcugcacuucaagcaguacgaguucaacuccaccccgaacaaccaggugaugcugugcgagcccaccaucaucgagcgcaacaucaccgagaucguguaccucacgaacaccaccaucgagaaggagaucugccccaagcuggccgaguaccggaacuggagcaagccccagugcgacaucaccggguucgcgccguucuccaaggacaacagcauccgccuguccgccggcggggacaucugggucacgcgggagcccuacgugagcugcgaccccgacaagugcuaccaguucgcccucggccaggggaccacccugaacaacgugcacuccaacgacaccguccgcgaccggacgcccuaccgcacccugcucaugaacgagcugggcgugccguuccaccugggcaccaagcaggucugcaucgccuggagcuccagcuccugccacgacgggaaggccuggcuccacgugugcaucaccggcgacgacaagaacgcgacggccagcuucaucuacaacgggcggcugguggacuccaucgugagcugguccaaggagauccugcgcacccaggagagcgagugcgucugcaucaacgggaccugcaccguggugaugacggacggguccgccagcggcaaggccgacaccaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgccccaucguggacaucaacaucaaggaccacuccaucgugagcuccuacgucugcagcggccuggugggcgacacgccgcggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggacguccaacagcaucguggucuucugcggcaccuccgggaccuacggcaccgggagcuggcccgacggcgccgacaucaaccugaugccgaucuga

SEQ ID NO: 77089 - RNA, 1413 nt, Artificial Sequence; identical to SEQ ID NO: 77079
  derived and/or modified sequence opt1 from neuraminidase__InfluenzaA__ABV30297

SEQ ID NO: 77090 - RNA, 1413 nt, Artificial Sequence
  derived and/or modified sequence opt1 from neuraminidase__InfluenzaA__ABV30308
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugccucaacggcagcugcuucaccaucaugacggacgggcccuccaacggcgccgccagcuacaagaucuucaagaucgagaaggggaaggugaccaaguccaucgagcugaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggagcugcaacccggugacgguggacggcgcggacggggucaagggcuucuccuacaaguacggcaacgggguguggaucggccggaccaagagcaaccgccuccggaagggguucgagaugaucugggaccccaacggcuggaccgacaccgacuccgacuucagcgugaagcaggacgucguggccaucacggacuggagcggguacuccggcagcuucgugcagcaccccgagcugaccggccuggacugcauccgccccugcuucugggucgagcucgugcgggggcugccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77091 - RNA, 1413 nt, Artificial Sequence
  derived and/or modified sequence opt1 from neuraminidase__InfluenzaA__ABV30319
augaaccccaaccagaagaucaucaccaucggcagcaucuccaucgccaucgggaucaucagccugaugcuccagaucggcaacaucguguccaucugggccagccacuccauccagaccgggagccagaaccacacgggcaucugcaaccagcgcaucaucaccuacgagaacuccaccugggucaaccacaccuacgugagcaucaacaacacgaacguggucgcggggaaggacaagaccuccgugacccuggccggcaacagcucccugugcagcaucuccggcugggccaucuacaccaaggacaacagcauccggaucggguccaagggcgacguguucgucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcggucgccgugcugaaguacaacggcaucaucacggagaccaucaagagcuggaagaagcgcauccugcggacccaggaguccgagugcgugugcgucaacggcagcugcuucaccaucaugacggacgggcccuccaacggcgccgccagcuacaagaucuucaagaucgagaaggggaaggugaccaaguccaucgagcucaacgcccccaacuuccacuacgaggagugcagcugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggagcugcaacccggucacgguggacggcgcggacggggugaagggcuucuccuacaaguacggcaacggggucuggaucggccggaccaagagcaaccgccugcggaagggguucgagaugaucugggaccccaacggcuggaccgacaccgacuccgacuucagcgugaagcaggacguggucgccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77092 - RNA, 1413 nt, Artificial Sequence; identical to SEQ ID NO: 77079
  derived and/or modified sequence opt1 from neuraminidase__InfluenzaA__ABV30330

SEQ ID NO: 77093 - RNA, 1413 nt, Artificial Sequence; identical to SEQ ID NO: 77038
  derived and/or modified sequence opt1 from neuraminidase__InfluenzaA__ABV30341

SEQ ID NO: 77094 - RNA, 1413 nt, Artificial Sequence; identical to SEQ ID NO: 77038
  derived and/or modified sequence opt1 from neuraminidase__InfluenzaA__ABV30363

SEQ ID NO: 77095 - RNA, 1413 nt, Artificial Sequence; identical to SEQ ID NO: 77038
  derived and/or modified sequence opt1 from neuraminidase__InfluenzaA__ABV30374

SEQ ID NO: 77096 - RNA, 1410 nt, Artificial Sequence
  derived and/or modified sequence opt1 from neuraminidase__InfluenzaA__ABV30385
augaaccccaaccagaagaucaucaccaucggcagcgugucccugaccaucagcacgaucugcuucuucaugcagaucgccauccucaucaccaccgucacccugcacuucaagcaguacgaguucuccccgccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuacccgggcguccggugcgugugccgcgacaacuggaaggggagcaaccggcccaucguggacaucaacaucaaggacuacuccaucgucagccgcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggagcggcuacgagaccuucaaggucaucgagggguggagcaacccgaacuccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugcccaucuga

SEQ ID NO: 77097 - RNA, 1410 nt, Artificial Sequence
  derived and/or modified sequence opt1 from neuraminidase__InfluenzaA__ABV30396
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuguccgaguaccggaacuggagcaagccccagugcaacaucaccggguucgccccguucuccaaggacaacagcauccgccuguccgcgggcggggacaucugggucacccgggagcccuacgugagcugcgaccccgacaagugcuaccaguucgcccucggccaggggaccacgcugaacaacgugcacuccaacgacaccguccacgaccgcacccccuaccggacccugcucaugaacgagcugggcgugccguuccaccugggcacgaagcaggucugcaucgccuggagcuccagcuccugccacgacgggaaggccuggcuccacgugugcgugaccggcgacgacaagaacgccaccgcgagcuucaucuacaacgggcgccugguggacuccaucgucagcugguccaaggagauccugcggacccaggagagcgagugcgugugcaucaacggcacgugcaccguggucaugaccgacgggagcgccuccggcaaggccgacaccaagauccucuucaucgaggagggcaagaucgugcacacgagcacccuguccgggagcgcccagcacguggaggagugcuccugcuacccccgcuaccccggcguccggugcgugugccgcgacaacuggaaggggagcaaccggcccaucguggacaucaacaucaaggacuacuccaucgucagcuccuacgugugcagcggccuggugggcgacaccccgcgcaagaacgacuccagcuccagcucccacugccucgaccccaacaacgaggagggcgggcacggggucaagggcugggcguucgacgacgggaacgacguguggaugggccggaccaucagcgagaagcugcgcuccggcuacgagacguucaaggucaucgagggguggagcaaccccaacuccaagcugcagaucaaccgccaggugaucguggaccggggcaaccggagcggguacagcggcaucuucuccgucgagggcaagagcugcaucaaccgcugcuucuacguggagcucauccgggggcgcaaggaggagaacgaggugcuguggaccuccaacagcaucgucguguucugcggcaccuccgggaccuacggcacggggagcuggcccgacggcgccgacaucaaccugaugccgaucuga

SEQ ID NO: 77098 - RNA, 1410 nt, Artificial Sequence
  derived and/or modified sequence opt1 from neuraminidase__InfluenzaA__ABV30407
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggaccagcggcacguacgggaccggcuccuggccggacggggccgacaucaaccugaugcccaucuga

SEQ ID NO: 77099 - RNA, 1410 nt, Artificial Sequence
  derived and/or modified sequence opt1 from neuraminidase__InfluenzaA__ABV30418
augaaccccaaccagaagaucaucaccaucggcagcgugucccugaccaucagcacgaucugcuucuucaugcagaucgccauccucaucaccaccgucacccugcacuucaagcaguacgaguucuccagccugccgaacaaccaggugaugcucugcgagcccacgaucaucgagcgcaacaucaccgagaucguguaccugaccaacaccacgaucgagaaggagaucugccccaagcuggccgaguaccggaacugguccaagccccagugcgacaucaccggguucgcgccguucagcaaggacaacuccauccgccucagcgccggcggggacaucugggucacccgggagcccuacguguccugcgaccccgacaagugcuaccaguucgcccugggccaggggaccacgcugaacaacgugcacagcaacgacaccguccacgaccgcacccccuaccggacccuccugaugaacgagcugggcgugccguuccaccucggcacgaagcaggucugcaucgccugguccagcuccagcugccacgacgggaaggccuggcugcacgugugcgugaccggcgacgacaagaacgcgaccgccuccuucaucuacaacgggcgccugguggacagcaucgucuccuggagcaaggagauccuccggacccaggaguccgagugcgugugcaucaacggcacgugcaccguggucaugaccgacgggagcgccagcggcaaggccgacaccaagauccuguucaucgaggagggcaagaucgugcacacguccacccugagcggguccgcgcagcacguggaggagugcagcugcuacccccgcuaccccggcguccggugcgugugccgcgacaacuggaagggguccaaccggcccaucguggacaucaacaucaaggacuacagcaucgucucccgcuacgugugcagcggccucgugggcgacaccccgcggaagaacgacuccagcuccagcucccacugccuggaccccaacaacgaggagggcgggcacggggucaagggcugggccuucgacgacgggaacgacguguggaugggccgcaccaucagcgagaagucccggagcggcuacgagacguucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcucauccgcggccggcgcgaggagaccgaggugcuguggaccagcaacuccaucgucguguucugcggcaccagcgggacguacggcaccggguccuggcccgacggcgccgacaucaaccugaugccgaucuga

SEQ ID NO: 77100 - RNA, 1410 nt, Artificial Sequence; identical to SEQ ID NO: 77065
  derived and/or modified sequence opt1 from neuraminidase__InfluenzaA__ABV30429

SEQ ID NO: 77101 - RNA, 1410 nt, Artificial Sequence; identical to SEQ ID NO: 77065
  derived and/or modified sequence opt1 from neuraminidase__InfluenzaA__ABV30440

SEQ ID NO: 77102 - RNA, 1410 nt, Artificial Sequence; identical to SEQ ID NO: 77065
  derived and/or modified sequence opt1 from neuraminidase__InfluenzaA__ABV30451

SEQ ID NO: 77103 - RNA, 1413 nt, Artificial Sequence; identical to SEQ ID NO: 77038
  derived and/or modified sequence opt1 from neuraminidase__InfluenzaA__ABV30462

SEQ ID NO: 77104 - RNA, 1410 nt, Artificial Sequence; identical to SEQ ID NO: 77065
  derived and/or modified sequence opt1 from neuraminidase__InfluenzaA__ABV30473

SEQ ID NO: 77105 - RNA, 1410 nt, Artificial Sequence
  derived and/or modified sequence opt1 from neuraminidase__InfluenzaA__ABV30484
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagccgcuacgugugcuccggccuggugggcgacacgccccggaagaacgacagcuccagcaacucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcaccagcgggacguacggcaccggguccuggccggacggcgccgacaucaaccugaugcccaucuga

SEQ ID NO: 77106 - RNA, 1413 nt, Artificial Sequence; identical to SEQ ID NO: 77077
  derived and/or modified sequence opt1 from neuraminidase__InfluenzaA__ABV30495

SEQ ID NO: 77107 - RNA, 1413 nt, Artificial Sequence; identical to SEQ ID NO: 77038
  derived and/or modified sequence opt1 from neuraminidase__InfluenzaA__ABV30506

SEQ ID NO: 77108 - RNA, 1410 nt, Artificial Sequence; identical to SEQ ID NO: 77074
  derived and/or modified sequence opt1 from neuraminidase__InfluenzaA__ABV30517

SEQ ID NO: 77109 - RNA, 1413 nt, Artificial Sequence
  derived and/or modified sequence opt1 from neuraminidase__InfluenzaA__ABV30528
augaacagcaaccagaagaucaucaccaucggcuccaucagcaucgccaucgggaucaucucccugaugcuccagaucggcaacaucaucagcaugugggccucccacagcauccagaccgggucccagaaccacacgggcaucugcaaccagcgcaucaucaccuacgagaacagcaccugggugaaccacaccuacgucaacaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagcccuucaucagcugcucccaccucgagugccggacguucuuccugacccagggggcccugcucaacgacaagcacagcaacggcaccgucaaggaccgcuccccguaccgggcccugaugagcugcccccugggggaggcgcccagccccuacaacuccaaguucgagagcguggccugguccgccagcgccugccacgacggcaugggcuggcucaccaucgggaucuccggcccggacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuaccccgacaccggcaccgugaugugcgugugccgcgacaacuggcacggguccaaccggccgugggucagcuucaaccagaaccuggacuaccaggugggcuacaucugcuccggcguguucggggacaacccccgccccaaggacggcaaggggagcugcaaccccaugacggucgacggcgcggacggggugaagggcuucuccuacaaguacggcaacgggguguggaucggccggaccaagagcaacaagcugcgcaagggguucgagaugaucugggacccgaacggcuggaccgacaccgacuccgacuucagcgucaagcaggacgugguggccaucacggacuggagcggguacuccggcagcuucguccagcaccccgagcucaccggccuggacugcauccggcccugcuucuggguggagcugguccgcgggcucccccgggagaacgccaccaucuggaccuccggcagcuccaucagcuucugcgggguggacuccgacacggccaacuggagcuggccggacggcgccgagcugcccuucaccaucgacaaguga

SEQ ID NO: 77110 - RNA, 1413 nt, Artificial Sequence; identical to SEQ ID NO: 77038
  derived and/or modified sequence opt1 from neuraminidase__InfluenzaA__ABV30539

SEQ ID NO: 77111 - RNA, 1413 nt, Artificial Sequence; identical to SEQ ID NO: 77038
  derived and/or modified sequence opt1 from neuraminidase__InfluenzaA__ABV30561

SEQ ID NO: 77112 - RNA, 1413 nt, Artificial Sequence; identical to SEQ ID NO: 77038
  derived and/or modified sequence opt1 from neuraminidase__InfluenzaA__ABV30572

SEQ ID NO: 77113 - RNA, 1413 nt, Artificial Sequence; identical to SEQ ID NO: 77038
  derived and/or modified sequence opt1 from neuraminidase__InfluenzaA__ABV30583

SEQ ID NO: 77114 - RNA, 1413 nt, Artificial Sequence; identical to SEQ ID NO: 77038
  derived and/or modified sequence opt1 from neuraminidase__InfluenzaA__ABV30594

SEQ ID NO: 77115 - RNA, 1413 nt, Artificial Sequence
  derived and/or modified sequence opt1 from neuraminidase__InfluenzaA__ABV30605
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggucgggaaggacaagaccuccgugacccuggcgggcaacagcucccugugcagcaucuccggcugggccaucuacaccaaggacaacagcauccggaucggguccaagggcgacguguucgucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcccccagcccguacaacuccaaguucgagagcguggcgugguccgccagcgccugccacgacggcaugggcuggcucaccaucgggaucuccggccccgacaacggggccgucgcggugcugaaguacaacggcaucaucacggagaccaucaagagcuggaagaagcgcauccugcggacccaggaguccgagugcgugugcgucaacggcagcugcuucaccaucaugacggacgggcccuccaacggcgccgccagcuacaagaucuucaagaucgagaaggggaaggugaccaaguccaucgagcucaacgcccccaacuuccacuacgaggagugcagcugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggagcugcaacccggucacgguggacggcgccgacggggugaagggcuucuccuacaaguacggcaacggggucuggaucggccggaccaagagcaaccgccugcggaagggguucgagaugaucugggaccccaacggcuggaccgacaccgacuccgacuucagcgugaagcaggacguggucgcgaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77116 - RNA, 1413 nt, Artificial Sequence; identical to SEQ ID NO: 77038
  derived and/or modified sequence opt1 from neuraminidase__InfluenzaA__ABV30616

SEQ ID NO: 77117 - RNA, 1413 nt, Artificial Sequence; identical to SEQ ID NO: 77038
  derived and/or modified sequence opt1 from neuraminidase__InfluenzaA__ABV30627

SEQ ID NO: 77118 - RNA, 1410 nt, Artificial Sequence
  derived and/or modified sequence opt1 from neuraminidase__InfluenzaA__ABV30649
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaacgccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77119 - RNA, 1410 nt, Artificial Sequence; identical to SEQ ID NO: 76892
  derived and/or modified sequence opt1 from neuraminidase__InfluenzaA__ABV30660

SEQ ID NO: 77120 - RNA, 1413 nt, Artificial Sequence
  derived and/or modified sequence opt1 from neuraminidase__InfluenzaA__ABV45852
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccaacaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccaacuucagcgucaagcaggacgugguggccaucacggacugguccggguacagcggcagcuucguccagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 77121 - RNA, 1410 nt, Artificial Sequence; identical to SEQ ID NO: 76892
  derived and/or modified sequence opt1 from neuraminidase__InfluenzaA__ABV45863

SEQ ID NO: 77122 - RNA, 1413 nt, Artificial Sequence
  derived and/or modified sequence opt1 from neuraminidase__InfluenzaA__ABV45874
augaaccccaaccagaagaucaucaccaucggcagcaucuccaucgccaucgggaucaucagccugaugcuccagaucggcaacaucaucuccaucugggccagcuacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77123 - RNA, 1413 nt, Artificial Sequence; identical to SEQ ID NO: 77038
  derived and/or modified sequence opt1 from neuraminidase__InfluenzaA__ABV45885

SEQ ID NO: 77124 - RNA, 1413 nt, Artificial Sequence; identical to SEQ ID NO: 77051
  derived and/or modified sequence opt1 from neuraminidase__InfluenzaA__ABV45896

SEQ ID NO: 77125 - RNA, 1413 nt, Artificial Sequence; identical to SEQ ID NO: 77038
  derived and/or modified sequence opt1 from neuraminidase__InfluenzaA__ABV45918

SEQ ID NO: 77126 - RNA, 1413 nt, Artificial Sequence
  derived and/or modified sequence opt1 from neuraminidase__InfluenzaA__ABV45929
augaaccccaaccagaagaucaucaccaucggcagcaucuccaucgccaucgggaucaucagccugaugcuccagaucggcaacaucaucuccaugugggccagccacuccauccagaccgggagccagaaccacacgggcaucugcaaccagcgcaucaucaccuacgagaacuccaccugggugaaccacaccuacgucaacaucaacaacacgaacguggugaccgggaaggacaagaccagcgucacccuggcgggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcccccagcccguacaacagcaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcgcauccugcggacccaggagagcgagugcgugugcgugaacggcuccugcuucacgaucaugaccgacgggcccagcgacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgccgacggggugaagggcuucagcuacaaguacggcaacgggguguggaucggccggaccaaguccaacaagcugcgcaagggguucgagaugaucugggaccccaacggcuggaccgacacggacaacgacuucagcgucaagcaggacgugguggcgaucaccgacugguccggguacagcggcagcuucguccagcaccccgagcucaccggccuggacugcauccggcccugcuucuggguggagcugguccgcgggcucccgcgggagaacgccaccaucuggacguccggcagcuccaucagcuucugcgggguggacuccgacaccgccaacuggagcuggcccgacggcgccgagcugcccuucaccaucgacaaguga

SEQ ID NO: 77127 - RNA, 1413 nt, Artificial Sequence
  derived and/or modified sequence opt1 from neuraminidase__InfluenzaA__ABV45940
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucauccgguacgagaacuccaccugggugaaccacaccuacgucaacaucaacaacaccaacgugguggcggggaaggacaagacgagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacgcagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcagauccugcggacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagagccuggacuaccaggugggcuacaucugcuccggcguguucggggacaacccccgccccaaggacggcaaggggagcugcaacccgaugaccgucgacggcgcggacggggugaagggcuucuccuacaaguacggcaacgggguguggaucggccggaccaagagcaacaagcugcgcaagggguucgagaugaucugggaccccaacggcuggacggacaccgacuccgacuucagcgucaagcaggacgugguggccaucaccgacuggagcggguacuccggcagcuucguccagcaccccgagcucacgggccuggacugcauccggcccugcuucuggguggagcugguccgcgggcucccgcgggagaacaccaccaucuggaccuccggcagcuccaucagcuucugcgggguggacuccgacacggccaacuggagcuggcccgacggcgccgagcugcccuucaccaucgacaaguga

SEQ ID NO: 77128 - RNA, 1413 nt, Artificial Sequence; identical to SEQ ID NO: 77064
  derived and/or modified sequence opt1 from neuraminidase__InfluenzaA__ABV45951

SEQ ID NO: 77129 - RNA, 1410 nt, Artificial Sequence
  derived and/or modified sequence opt1 from neuraminidase__InfluenzaA__ABV45973
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgacgugcuguggaccuccaacagcaucguggucuucugcggcaccuccgggacguacggcaccgggagcuggccggacggcgccgacaucaaccugaugcccaucuga

SEQ ID NO: 77130 - RNA, 1410 nt, Artificial Sequence
  derived and/or modified sequence opt1 from neuraminidase__InfluenzaA__ABV45984
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77131 - RNA, 1410 nt, Artificial Sequence; identical to SEQ ID NO: 76892
  derived and/or modified sequence opt1 from neuraminidase__InfluenzaA__ABV45995

SEQ ID NO: 77132 - RNA, 1413 nt, Artificial Sequence; identical to SEQ ID NO: 77051
  derived and/or modified sequence opt1 from neuraminidase__InfluenzaA__ABV82554

SEQ ID NO: 77133 - RNA, 1410 nt, Artificial Sequence; identical to SEQ ID NO: 77074
  derived and/or modified sequence opt1 from neuraminidase__InfluenzaA__ABV82565

SEQ ID NO: 77134 - RNA, 1410 nt, Artificial Sequence; identical to SEQ ID NO: 77074
  derived and/or modified sequence opt1 from neuraminidase__InfluenzaA__ABW36171

SEQ ID NO: 77135 - RNA, 1413 nt, Artificial Sequence; identical to SEQ ID NO: 77090
  derived and/or modified sequence opt1 from neuraminidase__InfluenzaA__ABW36193

SEQ ID NO: 77136 - RNA, 1413 nt, Artificial Sequence; identical to SEQ ID NO: 77038
  derived and/or modified sequence opt1 from neuraminidase__InfluenzaA__ABW36204

SEQ ID NO: 77137 - RNA, 1413 nt, Artificial Sequence
  derived and/or modified sequence opt1 from neuraminidase__InfluenzaA__ABW36215
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaagggcuggcucaccaucgggaucagcggccccgacaacggggcgguggccguccugaaguacaacggcaucaucacggagaccaucaaguccuggaacaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggccgcggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagccacuucuccgucaagcaggacgugguggccaucacggacuggagcggguacagcggcuccuucguccagcaccccgagcucaccggccuggacugcaucaagcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaucaucgacaaguga

SEQ ID NO: 77138 - RNA, 1413 nt, Artificial Sequence; identical to SEQ ID NO: 77038
  derived and/or modified sequence opt1 from neuraminidase__InfluenzaA__ABW36226

SEQ ID NO: 77139 - RNA, 1413 nt, Artificial Sequence
  derived and/or modified sequence opt1 from neuraminidase__InfluenzaA__ABW36237
augaaccccaaccagaagaucaucaccaucggcagcaucuccaucaccaucgggaucaucagccugaugcuccagaucggcaacaucaucuccaucugggccagccacuccauccagacggggagccagaaccacaccggcaucugcaaccagcgcaucaucaccuacgagaacuccaccugggugaaccacacguacgucaacaucaacaacaccaacgugguggccgggaaggacaagaccagcgucacccuggcgggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcccccagcccguacaacagcaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugaccgucgacggcgccgacggggugaagggcuucagcuacaaguacggcaacgggguguggaucggccggaccaaguccaacaagcugcgcaagggguucgagaugaucugggaccccaacggcuggaccgacacggacagcgacuucuccgucaagcaggacgugguggcgaucaccgacuggagcggguacagcggcuccuucguccagcaccccgagcucaccggccuggacugcauccggcccugcuucuggguggagcugguccgcgggcucccgcgggagaacaccacgaucuggaccagcggcuccagcaucuccuucugcgggguggacagcgacaccgccaacugguccuggcccgacggcgccgagcugcccuucaccaucgacaaguga

SEQ ID NO: 77140 - RNA, 1413 nt, Artificial Sequence; identical to SEQ ID NO: 77038
  derived and/or modified sequence opt1 from neuraminidase__InfluenzaA__ABW36248

SEQ ID NO: 77141 - RNA, 1413 nt, Artificial Sequence
  derived and/or modified sequence opt1 from neuraminidase__InfluenzaA__ABW36259
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcagcggcguccugggggacaacccccgccccgaggacggcgagggguccugcaacccggugaccguggacggcgcggacggggucaagggcuucagcuacaaguacgacaacggcguguggaucgggcggacgaaguccaaccgccuccggaagggcuucgagaugaucugggaccccaacggguggaccaacaccgacagcgacuucuccgugaagcaggacgucguggccaucaccgacuggagcggcuacagcggguccuucgugcagcaccccgagcugacgggccuggacugcauccgccccugcuucugggucgagcucgugcggggccugccgcgcgagaacaccaccaucuggaccagcggguccagcaucuccuucugcggcgucagcuccgacacggccaacuggagcuggcccgacggggccgagcugcccuucaccaucgacaaguga

SEQ ID NO: 77142 - RNA, 1413 nt, Artificial Sequence; identical to SEQ ID NO: 77038
  derived and/or modified sequence opt1 from neuraminidase__InfluenzaA__ABW36281

SEQ ID NO: 77143 - RNA, 1413 nt, Artificial Sequence; identical to SEQ ID NO: 77038
  derived and/or modified sequence opt1 from neuraminidase__InfluenzaA__ABW36292

SEQ ID NO: 77144 - RNA, 1413 nt, Artificial Sequence; identical to SEQ ID NO: 77051
  derived and/or modified sequence opt1 from neuraminidase__InfluenzaA__ABW36303

SEQ ID NO: 77145 - RNA, 1413 nt, Artificial Sequence
  derived and/or modified sequence opt1 from neuraminidase__InfluenzaA__ABW36314
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcagcugcuucaccaucaugacggacgggcccuccgacggccaggccagcuaccgcaucuucaagaucgagaaggggaagaucaccaaguccaucgagcuggacgccccgaacuuccacuacgaggagugcagcugcuaccccgacaccggcaccgucaugugcgugugccgggacaacuggcacggguccaaccgccccugggugagcuucaaccagaaccucgacuaccagaucggcuacaucugcuccggcgucuucggggacaacccccggccgaaggacggcaaggggagcugcgaccccgugaacguggacggcgccgacggggucaagggcuucuccuaccgcuacggcaacgggguguggaucggccggaccaagagcaacuccagccgcaagggguucgagaugaucugggaccccaacggcuggacggacaccgacuccaacuuccuggugaagcaggacgucguggccaugaccgacuggagcggguacagcggcuccuucgugcagcaccccgagcugacgggccucgacugcaugcggccgugcuucugggucgagcugauccgcgggcggccccgcgagaagaccaccaucuggaccagcggcuccagcaucuccuucugcggggugaacagcgacacggucaacugguccuggcccgacggcgcggagcugcccuucaccaucgacaaguga

SEQ ID NO: 77146 - RNA, 1410 nt, Artificial Sequence
  derived and/or modified sequence opt1 from neuraminidase__InfluenzaA__ABW38366
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgccagcugguccaaggagauccugcggacccaggagagcgagugcgucugcaucaacggcacgugcaccguggugaugaccgacggguccgccagcggcaaggcggacaccaagauccucuucaucgaggagggcaagaucguccacacgagcacccuguccgggagcgcccagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 77147 - RNA, 1413 nt, Artificial Sequence; identical to SEQ ID NO: 77137
  derived and/or modified sequence opt1 from neuraminidase__InfluenzaA__ABW39780

SEQ ID NO: 77148 - RNA, 1413 nt, Artificial Sequence
  derived and/or modified sequence opt1 from neuraminidase__InfluenzaA__ABW39809
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagacccuggucacccuggccggcaacuccagccucugcuccaucagcggcugggccaucuacaccaaggacaacuccauccggaucgggagcaagggcgacguguucgugauccgcgagccguucaucuccugcagccaccuggagugccggacguucuuccugacccagggggcccuccugaacgacaagcacuccaacggcaccgucaaggaccgcagccccuaccgggcccugauguccugcccccucggggaggcgcccagcccguacaacagcaaguucgaguccguggccuggagcgccuccgccugccacgacggcaugggcuggcugaccaucgggaucagcggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccagcaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacagcgacuucuccgucaagcaggacgugguggccaucacggacuggagcggguacagcggcuccuucguccagcaccccgagcugaccggccuggacugcauccgccccugcuucuggguggagcucguccgggggcugccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77149 - RNA, 1413 nt, Artificial Sequence; identical to SEQ ID NO: 77051
  derived and/or modified sequence opt1 from neuraminidase__InfluenzaA__ABW39820

SEQ ID NO: 77150 - RNA, 1413 nt, Artificial Sequence
  derived and/or modified sequence opt1 from neuraminidase__InfluenzaA__ABW39831
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaacggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucagcuucaaccagaaccuggacuaccagaucggcuacaucugcuccgggguguucggcgacaacccccgcccgaaggacggggagggcagcugcaaccccgugacggucgacggggccaacggcgugaagggcuucuccuacaaguacgggaacggcguguggaucgggcggaccaagagcaaccgcauccggaagggcuucgagaugaucugggaccccaacggguggaccaacaccgacuccgacuucagcgucaagcaggacaucguggcgaucacggacugguccggcuacagcggcagcuucgugcagcaccccgagcugaccgggcucgacugcauccgcccgugcuucugggucgagcuggugcggggccugccccgcgagaacaccaccaucuggacguccgggagcuccaucagcuucugcggcgucaacggcgacaucgccaacugguccuggcccgacggggccgagcuccccuucaccaucgacaaguga

SEQ ID NO: 77151 - RNA, 1413 nt, Artificial Sequence; identical to SEQ ID NO: 77064
  derived and/or modified sequence opt1 from neuraminidase__InfluenzaA__ABW39842

SEQ ID NO: 77152 - RNA, 1413 nt, Artificial Sequence; identical to SEQ ID NO: 77038
  derived and/or modified sequence opt1 from neuraminidase__InfluenzaA__ABW39864

SEQ ID NO: 77153 - RNA, 1410 nt, Artificial Sequence; identical to SEQ ID NO: 77074
  derived and/or modified sequence opt1 from neuraminidase__InfluenzaA__ABW39875

SEQ ID NO: 77154 - RNA, 1413 nt, Artificial Sequence
  derived and/or modified sequence opt1 from neuraminidase__InfluenzaA__ABW39886
augaaccccaaccagaagaucaucaccaucggcagcaucuccaucgccaucgggaucaucagccugauccuccagaucggcaacaucaucuccaucugggccagccacuccauccagacccgcaaccagaaccacacggggaucugcaaccagcggaucaucaccuacgagaacagcaccugggugaaccacaccuacgucuccaucaacaacacgaacgugguggcgggcaaggacaagaccagcgucacccuggccgggaacuccagccugugcuccaucagcggcugggccaucuacaccaaggacaacuccauccgcaucggcagcaagggggacguguucgugauccgggagccguucaucuccugcagccaccucgagugccgcacguucuuccugacccagggcgcccugcucaacgacaagcacuccaacgggaccgucaaggaccggagccccuaccgcgcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcagcggcguguucggcgacaacccccggcccaaggacgggaagggcuccugcaacccggugacggucgacggggcggacggcgugaagggguucagcuacaaguacggcaacggcguguggaucgggcgcaccaaguccaaccggcugcgcaagggcuucgagaugaucugggaccccaacggguggaccgacaccgacagcgacuucuccgucaagcaggacgugguggccaucacggacuggagcggcuacagcggguccuucguccagcaccccgagcucaccggccuggacugcauccggcccugcuucuggguggagcugguccgcggccucccgcgggagaacaccaccaucuggacgagcggguccagcaucuccuucugcggcguggacagcgacaccgccaacugguccuggcccgacggggccgagcugcccuucaccaucgacaaguga

SEQ ID NO: 77155 - RNA, 1413 nt, Artificial Sequence; identical to SEQ ID NO: 77038
  derived and/or modified sequence opt1 from neuraminidase__InfluenzaA__ABW39897

SEQ ID NO: 77156 - RNA, 1413 nt, Artificial Sequence
  derived and/or modified sequence opt1 from neuraminidase__InfluenzaA__ABW39908
augaaccccaaccagaagaucaucaccaucggcagcaucuccaucgccaucgggaucaccagccugaugcuccagaucggcaacaucaucuccaucugggccagccacuccauccagacggggagccagaaccacaccggcaucugcaaccagcgcaucaucaccuacgagaacuccaccugggugaaccacacguacgucagcaucaacaacaccaacgugguggcggggaaggacaagaccuccgucacccuggccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggccaucaccgacuggagcggguacuccggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 77157 - RNA, 1413 nt, Artificial Sequence
  derived and/or modified sequence opt1 from neuraminidase__InfluenzaA__ABW39930
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccgacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77158 - RNA, 1413 nt, Artificial Sequence
  derived and/or modified sequence opt1 from neuraminidase__InfluenzaA__ABW39952
augaaccccaaccagaagaucaucaccaucggcagcaucuccaucaccaucgggaucaucagccugaugcuccagaucggcaacaucaucuccaucugggccagccacuccauccagacggggagccagaaccacaccggcaugugcaaccagcgcaucaucaccuacgagaacuccaccugggugaaccacacguacgucagcaucaacaacaccaacgugguggccgggaaggacaagaccuccgucacccuggcgggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcccccagcccguacaacuccaaguucgagagcguggcgugguccgccagcgccugccacgacggcaugggcuggcucacgaucgggaucuccggccccgacaacggggccguggcgguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggagcggguacuccggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 77159 - RNA, 1413 nt, Artificial Sequence; identical to SEQ ID NO: 77038
  derived and/or modified sequence opt1 from neuraminidase__InfluenzaA__ABW39963

SEQ ID NO: 77160 - RNA, 1413 nt, Artificial Sequence; identical to SEQ ID NO: 77038
  derived and/or modified sequence opt1 from neuraminidase__InfluenzaA__ABW39985

SEQ ID NO: 77161 - RNA, 1413 nt, Artificial Sequence
  derived and/or modified sequence opt1 from neuraminidase__InfluenzaA__ABW39996
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcaccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugaccgucgacggcgccgacggggugaagggcuucagcuacaaguacggcaacgggguguggaucggccggaccaaguccaacaagcugcgcaagggguucgagaugaucugggaccccaacggcuggaccgacacggacagcgacuucuccgucaagcaggacgugguggcgaucaccgacuggagcggguacagcggcuccuucguccagcaccccgagcucaccggccuggacugcauccggcccugcuucuggguggagcugguccgcgggcucccgcgggagaacaccacgaucuggaccagcggcuccagcaucuccuucugcgggguggacagcgacaccgccaacugguccuggcccgacggcgccgagcugcccuucaccaucgacaaguga

SEQ ID NO: 77162 - RNA, 1413 nt, Artificial Sequence; identical to SEQ ID NO: 77038
  derived and/or modified sequence opt1 from neuraminidase__InfluenzaA__ABW40007

SEQ ID NO: 77163 - RNA, 1413 nt, Artificial Sequence
  derived and/or modified sequence opt1 from neuraminidase__InfluenzaA__ABW40018
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacgggaucaagggcuucagcuacaaguacggcaacgggguguggaucggccggaccaaguccaaccgccugcggaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucgacggcgacaccgccaacuggagcuggcccgacggcgccgagcugcccuucaccaucgacaaguga

SEQ ID NO: 77164 - RNA, 1410 nt, Artificial Sequence; identical to SEQ ID NO: 76892
  derived and/or modified sequence opt1 from neuraminidase__InfluenzaA__ABW40029

SEQ ID NO: 77165 - RNA, 1413 nt, Artificial Sequence
  derived and/or modified sequence opt1 from neuraminidase__InfluenzaA__ABW40040
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggaucuggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77166 - RNA, 1413 nt, Artificial Sequence; identical to SEQ ID NO: 77038
  derived and/or modified sequence opt1 from neuraminidase__InfluenzaA__ABW40051

SEQ ID NO: 77167 - RNA, 1413 nt, Artificial Sequence; identical to SEQ ID NO: 77038
  derived and/or modified sequence opt1 from neuraminidase__InfluenzaA__ABW40062

SEQ ID NO: 77168 - RNA, 1410 nt, Artificial Sequence; identical to SEQ ID NO: 77074
  derived and/or modified sequence opt1 from neuraminidase__InfluenzaA__ABW40084

SEQ ID NO: 77169 - RNA, 1413 nt, Artificial Sequence
  derived and/or modified sequence opt1 from neuraminidase__InfluenzaA__ABW40095
augaaccccaaccagaagaucaucaccaucggcagcaucuccguggccaucgggaucaucagccugaugcuccagaucggcaacaucaucuccaucugggccagccacuccauccagaccgggagccagaaccacacgggcaucugcaaccagcgcaucaucaccuacgagaacuccaccugggucaaccacaccuacgugagcaucaacaacacgaacguggucgcggggaaggacaagaccuccgugacccuggccggcaacagcucccugugcagcaucuccggcugggccaucuacaccaaggacaacagcauccggaucggguccaagggcgacguguucgucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcggucgccgugcugaaguacaacggcaucaucacggagaccaucaagagcuggaagaagcgcauccugcggacccaggaguccgagugcgugugcgucaacggcagcugcuucaccaucaugacggacgggcccuccaacggcgccgccagcuacaagaucuucaagaucgagaaggggaaggugaccaaguccaucgagcucaacgcccccaacuuccacuacgaggagugcagcugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggagcugcaacccgaugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77170 - RNA, 1413 nt, Artificial Sequence
  derived and/or modified sequence opt1 from neuraminidase__InfluenzaA__ABW40106
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugccucaacggcagcugcuucaccaucaugacggacgggcccuccaacggcgccgccagcuacaagaucuucaagaucgagaaggggaaggugaccaaguccaucgagcugaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggagcugcaacccggugacgguggacggcgcggacggggucaagggcuucuccuacaaguacggcaacgggguguggaucggccggaccaagagcaaccgccuccggaagggguucgagauggugugggaccccaacggcuggaccgacaccgacuccgacuucagcgucaagcaggacgugguggccaucacggacuggagcggguacuccggcagcuucguccagcaccccgagcugaccggccuggacugcauccgccccugcuucuggguggagcucguccgggggcugccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77171 - RNA, 1413 nt, Artificial Sequence; identical to SEQ ID NO: 77038
  derived and/or modified sequence opt1 from neuraminidase__InfluenzaA__ABW40117

SEQ ID NO: 77172 - RNA, 1413 nt, Artificial Sequence; identical to SEQ ID NO: 77038
  derived and/or modified sequence opt1 from neuraminidase__InfluenzaA__ABW40128

SEQ ID NO: 77173 - RNA, 1410 nt, Artificial Sequence; identical to SEQ ID NO: 76892
  derived and/or modified sequence opt1 from neuraminidase__InfluenzaA__ABW40139

SEQ ID NO: 77174 - RNA, 1413 nt, Artificial Sequence; identical to SEQ ID NO: 77038
  derived and/or modified sequence opt1 from neuraminidase__InfluenzaA__ABW40150

SEQ ID NO: 77175 - RNA, 1413 nt, Artificial Sequence; identical to SEQ ID NO: 77038
  derived and/or modified sequence opt1 from neuraminidase__InfluenzaA__ABW40161

SEQ ID NO: 77176 - RNA, 1410 nt, Artificial Sequence
  derived and/or modified sequence opt1 from neuraminidase__InfluenzaA__ABW40172
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucacccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 77177 - RNA, 1413 nt, Artificial Sequence; identical to SEQ ID NO: 77038
  derived and/or modified sequence opt1 from neuraminidase__InfluenzaA__ABW40183

SEQ ID NO: 77178 - RNA, 1410 nt, Artificial Sequence; identical to SEQ ID NO: 76892
  derived and/or modified sequence opt1 from neuraminidase__InfluenzaA__ABW40194

SEQ ID NO: 77179 - RNA, 1413 nt, Artificial Sequence; identical to SEQ ID NO: 77073
  derived and/or modified sequence opt1 from neuraminidase__InfluenzaA__ABW40205

SEQ ID NO: 77180 - RNA, 1413 nt, Artificial Sequence; identical to SEQ ID NO: 77077
  derived and/or modified sequence opt1 from neuraminidase__InfluenzaA__ABW40216

SEQ ID NO: 77181 - RNA, 1413 nt, Artificial Sequence; identical to SEQ ID NO: 77077
  derived and/or modified sequence opt1 from neuraminidase__InfluenzaA__ABW40227

SEQ ID NO: 77182 - RNA, 1413 nt, Artificial Sequence; identical to SEQ ID NO: 77038
  derived and/or modified sequence opt1 from neuraminidase__InfluenzaA__ABW40238

SEQ ID NO: 77183 - RNA, 1410 nt, Artificial Sequence
  derived and/or modified sequence opt1 from neuraminidase__InfluenzaA__ABW40249
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccacaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgacaucaaccugaugccgaucuga

SEQ ID NO: 77184 - RNA, 1413 nt, Artificial Sequence; identical to SEQ ID NO: 77038
  derived and/or modified sequence opt1 from neuraminidase__InfluenzaA__ABW40260

SEQ ID NO: 77185 - RNA, 1410 nt, Artificial Sequence
  derived and/or modified sequence opt1 from neuraminidase__InfluenzaA__ABW40271
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgagcaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77186 - RNA, 1413 nt, Artificial Sequence; identical to SEQ ID NO: 77038
  derived and/or modified sequence opt1 from neuraminidase__InfluenzaA__ABW40282

SEQ ID NO: 77187 - RNA, 1413 nt, Artificial Sequence; identical to SEQ ID NO: 77073
  derived and/or modified sequence opt1 from neuraminidase__InfluenzaA__ABW40293

SEQ ID NO: 77188 - RNA, 1413 nt, Artificial Sequence; identical to SEQ ID NO: 77038
  derived and/or modified sequence opt1 from neuraminidase__InfluenzaA__ABW40304

SEQ ID NO: 77189 - RNA, 1413 nt, Artificial Sequence; identical to SEQ ID NO: 77038
  derived and/or modified sequence opt1 from neuraminidase__InfluenzaA__ABW40315

SEQ ID NO: 77190 - RNA, 1410 nt, Artificial Sequence; identical to SEQ ID NO: 76892
  derived and/or modified sequence opt1 from neuraminidase__InfluenzaA__ABW40326

SEQ ID NO: 77191 - RNA, 1413 nt, Artificial Sequence; identical to SEQ ID NO: 77079
  derived and/or modified sequence opt1 from neuraminidase__InfluenzaA__ABW40337

SEQ ID NO: 77192 - RNA, 1413 nt, Artificial Sequence; identical to SEQ ID NO: 77073
  derived and/or modified sequence opt1 from neuraminidase__InfluenzaA__ABW40359

SEQ ID NO: 77193 - RNA, 1413 nt, Artificial Sequence
  derived and/or modified sequence opt1 from neuraminidase__InfluenzaA__ABW40370
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacuccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacagcgacuucagcgucaagcaggacgugguggccaucaccgacugguccggguacagcggcuccuucguccagcaccccgagcucacgggccuggacugcauccgccccugcuucuggguggagcugguccgggggcucccgcgcgagaacaccaccaucuggaccagcggcuccagcaucuccuucugcgggguggacagcgacacggccaacugguccuggcccgacggcgccgagcugcccuucaccaucgacaaguga

SEQ ID NO: 77194 - RNA, 1413 nt, Artificial Sequence; identical to SEQ ID NO: 77038
  derived and/or modified sequence opt1 from neuraminidase__InfluenzaA__ABW40403

SEQ ID NO: 77195 - RNA, 1413 nt, Artificial Sequence
  derived and/or modified sequence opt1 from neuraminidase__InfluenzaA__ABW40414
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucgaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77196 - RNA, 1413 nt, Artificial Sequence; identical to SEQ ID NO: 77038
  derived and/or modified sequence opt1 from neuraminidase__InfluenzaA__ABW40425

SEQ ID NO: 77197 - RNA, 1413 nt, Artificial Sequence; identical to SEQ ID NO: 77079
  derived and/or modified sequence opt1 from neuraminidase__InfluenzaA__ABW40436

SEQ ID NO: 77198 - RNA, 1413 nt, Artificial Sequence
  derived and/or modified sequence opt1 from neuraminidase__InfluenzaA__ABW40447
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccugaacugcauccggcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 77199 - RNA, 1413 nt, Artificial Sequence; identical to SEQ ID NO: 77064
  derived and/or modified sequence opt1 from neuraminidase__InfluenzaA__ABW40458

SEQ ID NO: 77200 - RNA, 1413 nt, Artificial Sequence; identical to SEQ ID NO: 77038
  derived and/or modified sequence opt1 from neuraminidase__InfluenzaA__ABW40469

SEQ ID NO: 77201 - RNA, 1413 nt, Artificial Sequence; identical to SEQ ID NO: 77038
  derived and/or modified sequence opt1 from neuraminidase__InfluenzaA__ABW40491

SEQ ID NO: 77202 - RNA, 1413 nt, Artificial Sequence; identical to SEQ ID NO: 77038
  derived and/or modified sequence opt1 from neuraminidase__InfluenzaA__ABW40502

SEQ ID NO: 77203 - RNA, 1413 nt, Artificial Sequence; identical to SEQ ID NO: 77079
  derived and/or modified sequence opt1 from neuraminidase__InfluenzaA__ABW40513

SEQ ID NO: 77204 - RNA, 1413 nt, Artificial Sequence; identical to SEQ ID NO: 77038
  derived and/or modified sequence opt1 from neuraminidase__InfluenzaA__ABW40524

SEQ ID NO: 77205 - RNA, 1413 nt, Artificial Sequence
  derived and/or modified sequence opt1 from neuraminidase__InfluenzaA__ABW40546
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcauggagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77206 - RNA, 1413 nt, Artificial Sequence; identical to SEQ ID NO: 77038
  derived and/or modified sequence opt1 from neuraminidase__InfluenzaA__ABW40557

SEQ ID NO: 77207 - RNA, 1413 nt, Artificial Sequence
  derived and/or modified sequence opt1 from neuraminidase__InfluenzaA__ABW40568
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcagauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcaaggggagcugcaacccggugacggucgacggcgcggacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccggcccugcuucuggguggagcugguccgcgggcucccgcgggagaacaccaccaucuggacguccggcagcuccaucagcuucugcgggguggacuccgacaccgccaacuggagcuggcccgacggcgccgagcugcccuucaccaucgacaaguga

SEQ ID NO: 77208 - RNA, 1413 nt, Artificial Sequence
  derived and/or modified sequence opt1 from neuraminidase__InfluenzaA__ABW40579
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccaacaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77209 - RNA, 1413 nt, Artificial Sequence
  derived and/or modified sequence opt1 from neuraminidase__InfluenzaA__ABW40601
augaaccccaaccagaagaucaucaccaucggcagcaucuccaucgccaucggggugaucagccugaugcuccagaucggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcaagggguccugcaacccggucacgguggacggcgcggacgggaucaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacggcgacaccgccaacuggagcuggcccgacggcgccgagcugcccuucaccaucgacaaguga

SEQ ID NO: 77210 - RNA, 1413 nt, Artificial Sequence; identical to SEQ ID NO: 77073
  derived and/or modified sequence opt1 from neuraminidase__InfluenzaA__ABW40612

SEQ ID NO: 77211 - RNA, 1413 nt, Artificial Sequence; identical to SEQ ID NO: 77038
  derived and/or modified sequence opt1 from neuraminidase__InfluenzaA__ABW40623

SEQ ID NO: 77212 - RNA, 1410 nt, Artificial Sequence; identical to SEQ ID NO: 76892
  derived and/or modified sequence opt1 from neuraminidase__InfluenzaA__ABW40634

SEQ ID NO: 77213 - RNA, 1413 nt, Artificial Sequence; identical to SEQ ID NO: 77038
  derived and/or modified sequence opt1 from neuraminidase__InfluenzaA__ABW40645

SEQ ID NO: 77214 - RNA, 1410 nt, Artificial Sequence
  derived and/or modified sequence opt1 from neuraminidase__InfluenzaA__ABW40656
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcgggggcaucugggucacccgggagcccuacgugagcugcgaccccgacaagugcuaccaguucgcccucgggcagggcaccacgcugaacaacgugcacuccaacgacaccguccgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 77215 - RNA, 1413 nt, Artificial Sequence; identical to SEQ ID NO: 77079
  derived and/or modified sequence opt1 from neuraminidase__InfluenzaA__ABW40667

SEQ ID NO: 77216 - RNA, 1413 nt, Artificial Sequence; identical to SEQ ID NO: 77064
  derived and/or modified sequence opt1 from neuraminidase__InfluenzaA__ABW40678

SEQ ID NO: 77217 - RNA, 1413 nt, Artificial Sequence; identical to SEQ ID NO: 77073
  derived and/or modified sequence opt1 from neuraminidase__InfluenzaA__ABW71297

SEQ ID NO: 77218 - RNA, 1413 nt, Artificial Sequence; identical to SEQ ID NO: 77079
  derived and/or modified sequence opt1 from neuraminidase__InfluenzaA__ABW71308

SEQ ID NO: 77219 - RNA, 1413 nt, Artificial Sequence; identical to SEQ ID NO: 77038
  derived and/or modified sequence opt1 from neuraminidase__InfluenzaA__ABW71319

SEQ ID NO: 77220 - RNA, 1413 nt, Artificial Sequence; identical to SEQ ID NO: 77038
  derived and/or modified sequence opt1 from neuraminidase__InfluenzaA__ABW71330

SEQ ID NO: 77221 - RNA, 1413 nt, Artificial Sequence
  derived and/or modified sequence opt1 from neuraminidase__InfluenzaA__ABW71341
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggcugggccggaccaagagcaaccgccuccggaagggguucgagaugaucugggaccccaacggcuggaccgacaccgacuccgacuucagcgucaagcaggacgugguggccaucacggacuggagcggguacuccggcagcuucguccagcaccccgagcugaccggccuggacugcauccgccccugcuucuggguggagcucguccgggggcugccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77222 - RNA, 1410 nt, Artificial Sequence; identical to SEQ ID NO: 77065
  derived and/or modified sequence opt1 from neuraminidase__InfluenzaA__ABW71352

SEQ ID NO: 77223 - RNA, 1413 nt, Artificial Sequence; identical to SEQ ID NO: 77079
  derived and/or modified sequence opt1 from neuraminidase__InfluenzaA__ABW71363

SEQ ID NO: 77224 - RNA, 1413 nt, Artificial Sequence; identical to SEQ ID NO: 77064
  derived and/or modified sequence opt1 from neuraminidase__InfluenzaA__ABW71374

SEQ ID NO: 77225 - RNA, 1413 nt, Artificial Sequence; identical to SEQ ID NO: 77038
  derived and/or modified sequence opt1 from neuraminidase__InfluenzaA__ABW71385

SEQ ID NO: 77226 - RNA, 1413 nt, Artificial Sequence
  derived and/or modified sequence opt1 from neuraminidase__InfluenzaA__ABW71396
augaaccccaaccagaagaucaucaccaucggcagcaucuccaucgccaucgggaucaucagccugaugcuccagaucggcaacaucaucuccaucugggccagccacuccgugcagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccaggugggcuacaucugcagcggcgucuucggggacaacccccgccccaaggacggcaagggguccugcaacccgaugacgguggacggcgcggacggggugaagggcuucagcuacaaguacggcaacggggucuggaucggccggaccaaguccaacaagcugcgcaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccggcccugcuucugggucgagcuggugcgcgggcucccgcgggagaacgccaccaucuggaccagcggcuccagcaucuccuucugcgggguggacagcgacacggccaacugguccuggcccgacggcgccgagcugcccuucaccaucgacaaguga

SEQ ID NO: 77227 - RNA, 1413 nt, Artificial Sequence
  derived and/or modified sequence opt1 from neuraminidase__InfluenzaA__ABW71407
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacaagauccgcaagggguucgagaugaucugggaccccaacggcuggaccgacaccgacagcgacuucuccgucaagcaggacgugguggccaucacggacuggagcggguacagcggcuccuucguccagcaccccgagcugaccggccucgacugcauccggcccugcuucuggguggagcugguccgcgggcugccgcgggagaacaccaccaucuggacgagcggcuccagcaucuccuucugcgggguggacagcgacaccgccaacugguccuggcccgacggcgccgagcuccccuucaccaucgacaaguga

SEQ ID NO: 77228 - RNA, 1413 nt, Artificial Sequence; identical to SEQ ID NO: 77064
  derived and/or modified sequence opt1 from neuraminidase__InfluenzaA__ABW71418

SEQ ID NO: 77229 - RNA, 1413 nt, Artificial Sequence; identical to SEQ ID NO: 77038
  derived and/or modified sequence opt1 from neuraminidase__InfluenzaA__ABW71440

SEQ ID NO: 77230 - RNA, 1413 nt, Artificial Sequence; identical to SEQ ID NO: 77038
  derived and/or modified sequence opt1 from neuraminidase__InfluenzaA__ABW71451

SEQ ID NO: 77231 - RNA, 1413 nt, Artificial Sequence; identical to SEQ ID NO: 77073
  derived and/or modified sequence opt1 from neuraminidase__InfluenzaA__ABW71462

SEQ ID NO: 77232 - RNA, 1410 nt, Artificial Sequence; identical to SEQ ID NO: 75335
  derived and/or modified sequence opt1 from neuraminidase__InfluenzaA__ABW80980

SEQ ID NO: 77233 - RNA, 1410 nt, Artificial Sequence; identical to SEQ ID NO: 75179
  derived and/or modified sequence opt1 from neuraminidase__InfluenzaA__ABW80981

SEQ ID NO: 77234 - RNA, 1413 nt, Artificial Sequence
  derived and/or modified sequence opt1 from neuraminidase__InfluenzaA__ABW81474
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagaagaucaucaccuacgagaaccgcaccugggucaaccagaccuacgugaacuucaacaacacgaacguggucgcggggaaggacaagccguccaugacccuggccggcaacagcucccugugccccauccggggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccaucaaggaccggucccccuuccgcgcccugaugagcugcccgcugggggaggcgcccucccccuacaacagccgguucgaguccgucgccuggagcgccagcgccugccacgacggccucggcuggcugaccaucgggaucuccggccccgacaacggggcgguggccgugcugaaguacaacggcaucaucaccgagacgaucaagagcuggaagaagcagauccuccgcacccaggaguccgagugcgucugcgugaacggcagcugcuucaccaucaugaccgacgggccguccaaccgggccgccagcuaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugagcuucaaccagaaccuggacuaccagaucggguacaucugcuccggcgucuucggcgacaacccgcgccccaaggacggggagggcagcugcaaccccgugaccguggacggggcggacggcgucaagggguucuccuaccgguacggcaacggcguguggaucgggcgcaccaagagcaaccggcuccgcaagggcuucgagaugaucugggaccccaacggguggacggacaccgacuccgacuucagcaugaagcaggacguggucgccaugaccgacugguccggcuacagcggguccuucgugcagcacccggagcugacgggccuggacugcaugcggcccugcuucuggguggagcucguccgcggccugccccgggagaacaccaccaucuggaccagcgggagcuccaucagcuucugcggcgugaacuccgagacggccaacuggagcuggcccgacggggccgagcugccguucaccaucgacaaguga

SEQ ID NO: 77235 - RNA, 1413 nt, Artificial Sequence
  derived and/or modified sequence opt1 from neuraminidase__InfluenzaA__ABW81475
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagagcuccgucacccuggccggcaacagcucccugugcagcaucuccggcugggccaucuacaccaaggacaacagcauccggaucggguccaagggcgacguguucgugauccgcgagccguucaucagcugcucccaccucgagugccggaccuucuuccugacgcagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucaccgagacgaucaagagcuggaagaagcgcauccugcggacccaggaguccgagugcgugugcgugaacggcagcugcuucaccaucaugaccgacgggcccuccaacggcgccgccagcuacaagaucuucaagaucgagaaggggaaggucacgaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucagccucaagcaggacgucguggccaucaccgacuggagcggguacuccggcagcuucgugcagcaccccgagcugacgggccuggacugcauccgccccugcuucugggucgagcucgugcgggggcugccgcgcgagaacaccaccaucuggaccuccggcagcuccaucagcuucugcggggucaacuccgacacggccaacuggagcuggcccgacggcgccgagcugcccuucaccaucgacaaguga

SEQ ID NO: 77236 - RNA, 1413 nt, Artificial Sequence
  derived and/or modified sequence opt1 from neuraminidase__InfluenzaA__ABW81477
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucuccgcccccaacuuccacuacgaggagugcagcugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcgaggggagcugcaacccggugacggucgacggcgcgaacggggugaagggcuucuccuacaaguacggcaacgggguguggaucggccgcaccaagagcaaccggcugcgcaagggguucgagaugaucugggaccccaacggcuggcccgacaccgacuccgacuucagcgucaagcaggacgugguggccaucaccgacuggagcggguacuccggcagcuucguccagcaccccgagcucacgggccuggacugcauccggccgugcuucuggguggagcugguccgcgggcuccccaaggagaacaccaccaucuggaccuccggcagcuccaucagcuucugcggggugaacuccgacacggccaacuggagcuggcccgacggcgccgagcugcccuucaccaucgacaaguga

SEQ ID NO: 77237 - RNA, 1413 nt, Artificial Sequence
  derived and/or modified sequence opt1 from neuraminidase__InfluenzaA__ABW81478
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaagaacaaccgccugcggaagggguucgagaugaucugggaccccaacggcuggaccgacaccgacuccgacuucagcgucaagcaggacgugguggccaucacggacugguccggguacagcggcagcuucguccagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 77238 - RNA, 1413 nt, Artificial Sequence
  derived and/or modified sequence opt1 from neuraminidase__InfluenzaA__ABW81479
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagaagaucaucaccuacgagaaccgcaccugggucaaccagaccuacgugaacaucaacaacacgaacguggucgcggggaaggacaagccguccaugacccuggccggcaacagcucccugugccccauccggggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccaucaaggaccggucccccuuccgcgcccugaugagcugcccgcugggggaggcgcccucccccuacaacagccgguucgaguccgucgccuggagcgccagcgccugccacgacggccucggcuggcugaccaucgggaucuccggccccgacaacggggcgguggccgugcugaaguacaacggcaucaucaccgagacgaucaagagcuggaagaagcagauccuccgcacccaggaguccgagugcgucugcgugaacggcagcugcuucaccaucaugaccgacgggccguccaaccgggccgccagcuaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugagcuucaaccagaaccuggacuaccagaucggguacaucugcuccggcgucuucggcgacaacccgcgccccaaggacggggagggcagcugcaaccccgugaccguggacggggcggacggcaucaagggguucuccuaccgguacggcaacggcgucuggaucgggcgcaccaagagcaaccggcuccgcaagggcuucgagaugaucugggaccccaacggguggacggacaccgacuccgacuucagcaugaagcaggacgugguggccaugaccgacugguccggcuacagcggguccuucguccagcacccggagcugacgggccuggacugcaugcggcccugcuucuggguggagcucgugcgcggccugccccgggagaacaccaccaucuggaccagcgggagcuccaucagcuucugcggcgucaacuccgagacggccaacuggagcuggcccgacggggccgagcugccguucaccaucgacaaguga

SEQ ID NO: 77239 - RNA, 1413 nt, Artificial Sequence; identical to SEQ ID NO: 75404
  derived and/or modified sequence opt1 from neuraminidase__InfluenzaA__ABW81480

SEQ ID NO: 77240 - RNA, 1413 nt, Artificial Sequence
  derived and/or modified sequence opt1 from neuraminidase__InfluenzaA__ABW81481
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagaagaucaucaccuacgagaaccgcaccugggucaaccagaccuacgugaacaucaacaacacgaacguggucgcggggaaggacaagccguccaugacccuggccggcaacagcucccugugccccauccggggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccaucaaggaccggucccccuuccgcgcccugaugagcugcccgcugggggaggcgcccucccccuacaacagccgguucgaguccgucgccuggagcgccagcgccugccacgacggccucggcuggcugaccaucgggaucuccggccccgacaacggggcgguggccgugcugaaguacaacggcaucaucaccgagacgaucaagagcuggaagaagcagauccuccgcacccaggaguccgagugcgucugcgugaacggcagcugcuucaccaucaugaccgacgggccguccaaccgggccgccagcuaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugagcuucaaccagaaccuggacuaccagaucggguacaucugcuccggcgucuucggcgacaacccgcgccccaaggacggggagggcagcugcaaccccgugaccguggacggggcggacggcgucaagggguucuccuaccgguacggcaacggcguguggaucgggcgcaccaagagcaaccggcuccgcaagggcuucgagaugaucugggaccccaacggguggacggacaccgacuccgacuucagcaugaagcaggacguggucgccaugaccgacugguccggcuacagcggguccuucgugcagcacccggagcugacgggccuggacugcaugcggcccugcuucuggguggagcucguccgcggccugccccgggagaacaccaccaucuggaccagcgggagcuccaucagcuucugcggcgugaacuccgagacggccaacuggagcuggcccgacggggccgagcugccguucaccaucgacaaguga

SEQ ID NO: 77241 - RNA, 1413 nt, Artificial Sequence
  derived and/or modified sequence opt1 from neuraminidase__InfluenzaA__ABW81482
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagaagaucaucaccuacgagaaccgcaccugggucaaccagaccuacgugaacaucaacaacacgaacguggucgcggggaaggacaagccguccaugacccuggccggcaacagcucccugugccccauccggggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccaucaaggaccggucccccuuccgcgcccugaugagcugcccgcugggggaggcgcccucccccuacaacagccgguucgaguccgucgccuggagcgccagcgccugccacgacggccucggcuggcugaccaucgggaucuccggccccgacaacggggcgguggccgugcugaaguacaacggcaucaucaccgagacgaucaagagcuggaagaagcagauccuccgcacccaggaguccgagugcgucugcgugaacggcagcugcuucaccaucaugaccgacgggccguccaaccgggccgccagcuaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugagcuucaaccagaaccuggacuaccagaucggguacaucugcuccggcgucuucggcgacaacccgcgccccaaggacggggagggcagcugcaaccccgugaccguggacggggcggacggcgucaagggguucuccuaccgguacggcaacggcguguggaucgggcgcaccaagagcaaccggcuccgcaagggcuucgagaugaucugggaccccaacggguggacggacaccgacuccgacuucagcaugaagcaggacguggucgccaugaccgacugguccggcuacagcggguccuucgugcagcacccggagcugacgggccuggccugcaugcggcccugcuucuggguggagcucguccgcggccugccccgggagaacaccaccaucuggaccagcgggagcuccaucagcuucugcggcgugaacuccgagacggccaacuggagcuggcccgacggggccgagcugccguucaccaucgacaaguga

SEQ ID NO: 77242 - RNA, 1413 nt, Artificial Sequence; identical to SEQ ID NO: 75394
  derived and/or modified sequence opt1 from neuraminidase__InfluenzaA__ABW81483

SEQ ID NO: 77243 - RNA, 1413 nt, Artificial Sequence
  derived and/or modified sequence opt1 from neuraminidase__InfluenzaA__ABW81484
augaaccccaaccagaagaucaucaccaucggcagcaucuccaucgccaucgggaucaucagccugaugcuccagaucggcaacaucaucuccaucugggccagccacuccauccagaccgggaaccagaaccacacgggcaucugcaaccagcgcaucaucaccuacgagaacagcaccugggugaaccacaccuacgucaacaucaacaacacgaacgugguggcggggaagggcaagaccuccgucacccuggccggcaacagcucccugugcagcaucuccgggugggccaucuacaccaaggacaacagcauccggaucggcuccaagggggacguguucgugauccgcgagccguucaucagcugcucccaccucgagugccggacguucuuccugacccagggcgcccugcucaacgacaagcacagcaacgggaccgucaaggaccgcucccccuaccgggcccugaugagcugcccccugggcgaggcgcccuccccguacaacagcaaguucgagagcguggccugguccgccagcgccugccacgacggcaugggguggcucaccaucggcaucuccgggcccgacaacggcgcgguggccguccugaaguacaacggcaucaucacggagaccaucaagagcuggaagaagcgcauccugcggacccaggaguccgagugcgugugcgugaacgggagcugcuucaccaucaugacggacggccccuccaacggggccgccagcuacaagaucuucaagaucgagaagggcaaggucaccaaguccaucgagcucaacgcccccaacuuccacuacgaggagugcagcugcuacccggacaccgggaccgugaugugcgugugccgcgacaacuggcacggcuccaaccggcccugggucagcuucaaccagaaccuggacuaccagaucggcuacaucugcuccgggguguucggcgacaacccccgccccaaggacgggaagggcagcugcaacccggugacggucgacggggcggacggcgugaagggcuucuccuacaaguacgggaacggcguguggaucgggcggaccaagagcaaccgccugcggaagggcuucgagaugaucugggaccccaacggguggaccgacaccgacuccgacuucagcgucaagcaggacgugguggccaucacggacugguccggcuacagcggcagcuucguccagcaccccgagcucaccgggcuggacugcauccgccccugcuucuggguggagcugguccggggccucccgcgcgagaacaccaccaucuggacguccgggagcuccaucagcuucugcggcguggacuccgacaccgccaacuggagcuggcccgacggcgccgagcugcccuucaccaucgacaaguga

SEQ ID NO: 77244 - RNA, 1413 nt, Artificial Sequence
  derived and/or modified sequence opt1 from neuraminidase__InfluenzaA__ABW81487
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucauccagcaccccgagcucaccggccuggacugcauccgccccugcuucugggucgagcuggugcgggggcucccgcgcgagaacaccaccaucuggacgagcggcuccagcaucuccuucugcggggucgacagcgacaccgccaacugguccuggcccgacggcgccgagcugcccuucaccaucgacaaguga

SEQ ID NO: 77245 - RNA, 1413 nt, Artificial Sequence; identical to SEQ ID NO: 75394
  derived and/or modified sequence opt1 from neuraminidase__InfluenzaA__ABW81488

SEQ ID NO: 77246 - RNA, 1413 nt, Artificial Sequence; identical to SEQ ID NO: 75394
  derived and/or modified sequence opt1 from neuraminidase__InfluenzaA__ABW81489

SEQ ID NO: 77247 - RNA, 1413 nt, Artificial Sequence
  derived and/or modified sequence opt1 from neuraminidase__InfluenzaA__ABW81490
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugcaagacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcaagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 77248 - RNA, 1413 nt, Artificial Sequence
  derived and/or modified sequence opt1 from neuraminidase__InfluenzaA__ABW81491
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77249 - RNA, 1413 nt, Artificial Sequence
  derived and/or modified sequence opt1 from neuraminidase__InfluenzaA__ABW81492
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucugggccagcggcuccagcaucuccuucugcgggguggacagcgacacggccaacugguccuggcccgacggcgccgagcugcccuucaccaucgacaaguga

SEQ ID NO: 77250 - RNA, 1413 nt, Artificial Sequence; identical to SEQ ID NO: 75394
  derived and/or modified sequence opt1 from neuraminidase__InfluenzaA__ABW81493

SEQ ID NO: 77251 - RNA, 1413 nt, Artificial Sequence; identical to SEQ ID NO: 75394
  derived and/or modified sequence opt1 from neuraminidase__InfluenzaA__ABW81494

SEQ ID NO: 77252 - RNA, 1413 nt, Artificial Sequence; identical to SEQ ID NO: 75394
  derived and/or modified sequence opt1 from neuraminidase__InfluenzaA__ABW81495

SEQ ID NO: 77253 - RNA, 1413 nt, Artificial Sequence; identical to SEQ ID NO: 77248
  derived and/or modified sequence opt1 from neuraminidase__InfluenzaA__ABW81497

SEQ ID NO: 77254 - RNA, 1413 nt, Artificial Sequence
  derived and/or modified sequence opt1 from neuraminidase__InfluenzaA__ABW81498
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77255 - RNA, 1413 nt, Artificial Sequence
  derived and/or modified sequence opt1 from neuraminidase__InfluenzaA__ABW81499
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggcgggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcaagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 77256 - RNA, 1413 nt, Artificial Sequence
  derived and/or modified sequence opt1 from neuraminidase__InfluenzaA__ABW81500
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggcggacggcgccgacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucgacagcgacaccgccaacugguccuggcccgacggcgccgagcugcccuucaccaucgacaaguga

SEQ ID NO: 77257 - RNA, 1413 nt, Artificial Sequence
  derived and/or modified sequence opt1 from neuraminidase__InfluenzaA__ABW81501
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagaagaucaucaccuacgagaacuccaccugggugaaccacaccuacgucaacaucaacaacacgaacgugguggcggggaaggacaagaccagcgucacccuggccggcaacuccagccugugcuccgugagcggcugggccaucuacaccaaggacaacuccauccgcaucgggagcaagggcgacguguucgucauccgggagccguucaucuccugcagccaccucgagugccgcacguucuuccugacccagggggcccugcucaacgacaagcacuccaacggcaccgugaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcggauccugcgcacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcagcggcguguucggggacaacccccggcccaaggacggcaagggguccugcaacccggucacgguggacggcgcggacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 77258 - RNA, 1413 nt, Artificial Sequence; identical to SEQ ID NO: 77079
  derived and/or modified sequence opt1 from neuraminidase__InfluenzaA__ABW86324

SEQ ID NO: 77259 - RNA, 1413 nt, Artificial Sequence; identical to SEQ ID NO: 77051
  derived and/or modified sequence opt1 from neuraminidase__InfluenzaA__ABW86335

SEQ ID NO: 77260 - RNA, 1413 nt, Artificial Sequence; identical to SEQ ID NO: 77038
  derived and/or modified sequence opt1 from neuraminidase__InfluenzaA__ABW86346

SEQ ID NO: 77261 - RNA, 1413 nt, Artificial Sequence; identical to SEQ ID NO: 77038
  derived and/or modified sequence opt1 from neuraminidase__InfluenzaA__ABW86357

SEQ ID NO: 77262 - RNA, 1413 nt, Artificial Sequence; identical to SEQ ID NO: 77038
  derived and/or modified sequence opt1 from neuraminidase__InfluenzaA__ABW86368

SEQ ID NO: 77263 - RNA, 1413 nt, Artificial Sequence; identical to SEQ ID NO: 77064
  derived and/or modified sequence opt1 from neuraminidase__InfluenzaA__ABW86379

SEQ ID NO: 77264 - RNA, 1413 nt, Artificial Sequence; identical to SEQ ID NO: 77038
  derived and/or modified sequence opt1 from neuraminidase__InfluenzaA__ABW86390

SEQ ID NO: 77265 - RNA, 1413 nt, Artificial Sequence; identical to SEQ ID NO: 77079
  derived and/or modified sequence opt1 from neuraminidase__InfluenzaA__ABW86401

SEQ ID NO: 77266 - RNA, 1413 nt, Artificial Sequence; identical to SEQ ID NO: 77038
  derived and/or modified sequence opt1 from neuraminidase__InfluenzaA__ABW86412

SEQ ID NO: 77267 - RNA, 1413 nt, Artificial Sequence
  derived and/or modified sequence opt1 from neuraminidase__InfluenzaA__ABW86423
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucgccaucaugaccgacgggcccagcaacggcgccgccuccuacaagaucuucaagaucgagaaggggaaggucaccaagagcaucgagcucaacgcgcccaacuuccacuacgaggagugcuccugcuacccggacacgggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugaccgucgacggcgccgacggggugaagggcuucagcuacaaguacggcaacgggguguggaucggccggacgaaguccaacaagcugcgcaagggguucgagaugaucugggaccccaacggcuggaccgacaccgacagcgacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccagcggcuccagcaucuccuucugcgggguggacagcgacacggccaacugguccuggcccgacggcgccgagcugcccuucaccaucgacaaguga

SEQ ID NO: 77268 - RNA, 1413 nt, Artificial Sequence; identical to SEQ ID NO: 77038
  derived and/or modified sequence opt1 from neuraminidase__InfluenzaA__ABW86434

SEQ ID NO: 77269 - RNA, 1413 nt, Artificial Sequence; identical to SEQ ID NO: 77038
  derived and/or modified sequence opt1 from neuraminidase__InfluenzaA__ABW86445

SEQ ID NO: 77270 - RNA, 1413 nt, Artificial Sequence; identical to SEQ ID NO: 77073
  derived and/or modified sequence opt1 from neuraminidase__InfluenzaA__ABW86456

SEQ ID NO: 77271 - RNA, 1413 nt, Artificial Sequence
  derived and/or modified sequence opt1 from neuraminidase__InfluenzaA__ABW86467
augaacaccaaccagaagaucaucaccaucggcagcaucuccaucgccaucgggaucaucagccugaugcuccagaucggcaacaucaucuccaucugggccagccacuccauccagacggggagccagaaccacaccggcaucugcaaccagcgcaucaucaccuacgagaacuccaccugggugaaccacacguacgucagcaucaacaacaccaacgugguggcggggaaggacaagaccuccgucacccuggccggcaacagcucccugugcagcaucuccggcugggccaucuacacgaaggacaacagcauccggaucggguccaagggcgacguguucgugauccgcgagcccuucaucagcugcucccaccucgagugccggaccuucuuccugacccagggggcccugcucaacgacaagcacagcaacggcaccgucaaggaccgcuccccguaccgggcccugaugagcugcccccugggggaggcgcccagccccuacaacuccaaguucgagagcguggccugguccgccagcgccugccacgacggcaugggcuggcucacgaucgggaucuccggcccggacaacggggcgguggccguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuaccccgacaccggcacggugaugugcgugugccgcgacaacuggcacggguccaaccggccgugggucagcuucaaccagaaccuggacuaccagaucggcuacaucugcuccggcguguucggggacaacccccgccccaaggacggcaaggggagcugcaaccccgugaccgucgacggcgcggacggggugaagggcuucuccuacaaguacggcaacgggguguggaucggccggaccaagagcaaccgccugcggaagggguucgagaugaucugggacccgaacggcuggaccgacacggacuccgacuucagcaucaagcaggacgucguggccaucaccgacuggagcggguacuccggcagcuucgugcagcaccccgagcucaccggccuggacugcauccgccccugcuucugggucgagcuggugcgggggcucccccgcgagaacaccacgaucuggaccuccggcagcuccaucagcuucugcggggucgacuccgacaccgccaacuggagcuggccggacggcgccgagcugcccuucaccaucgacaaguga

SEQ ID NO: 77272 - RNA, 1413 nt, Artificial Sequence; identical to SEQ ID NO: 77073
  derived and/or modified sequence opt1 from neuraminidase__InfluenzaA__ABW86478

SEQ ID NO: 77273 - RNA, 1413 nt, Artificial Sequence
  derived and/or modified sequence opt1 from neuraminidase__InfluenzaA__ABW86489
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggggaucacggacuggagcggcuacuccggcagcuucguccagcaccccgagcucaccgggcuggacugcauccgccccugcuucuggguggagcugguccggggccucccgcgcgagaacaccaccaucuggacguccgggagcuccaucagcuucugcggcguggacuccgacaccgccaacuggagcuggcccgacggcgccgagcugcccuucaccaucgacaaguga

SEQ ID NO: 77274 - RNA, 1413 nt, Artificial Sequence
  derived and/or modified sequence opt1 from neuraminidase__InfluenzaA__ABW86500
augaaccccaaccagaagaucaugaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccaugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucgacagcgacaccgccaacugguccuggcccgacggcgccgagcugcccuucaccaucgacaaguga

SEQ ID NO: 77275 - RNA, 1413 nt, Artificial Sequence; identical to SEQ ID NO: 77038
  derived and/or modified sequence opt1 from neuraminidase__InfluenzaA__ABW86511

SEQ ID NO: 77276 - RNA, 1413 nt, Artificial Sequence
  derived and/or modified sequence opt1 from neuraminidase__InfluenzaA__ABW86522
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccgucacggacuggagcggguacagcggcuccuucgugcagcaccccgagcucaccggccuggacugcauccggcccugcuucugggucgagcuggugcgcgggcucccgcgggagaacgccaccaucuggaccagcggcuccagcaucuccuucugcgggguggacagcgacacggccaacugguccuggcccgacggcgccgagcugcccuucaccaucgacaaguga

SEQ ID NO: 77277 - RNA, 1413 nt, Artificial Sequence; identical to SEQ ID NO: 77038
  derived and/or modified sequence opt1 from neuraminidase__InfluenzaA__ABW86533

SEQ ID NO: 77278 - RNA, 1413 nt, Artificial Sequence; identical to SEQ ID NO: 77073
  derived and/or modified sequence opt1 from neuraminidase__InfluenzaA__ABW86544

SEQ ID NO: 77279 - RNA, 1413 nt, Artificial Sequence; identical to SEQ ID NO: 77038
  derived and/or modified sequence opt1 from neuraminidase__InfluenzaA__ABW86555

SEQ ID NO: 77280 - RNA, 1410 nt, Artificial Sequence
  derived and/or modified sequence opt1 from neuraminidase__InfluenzaA__ABW86566
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccgugaucgagcgcaacaucaccgagaucgucuaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggacgacccugaacaacguccacuccaacgacaccgugcgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 77281 - RNA, 1413 nt, Artificial Sequence; identical to SEQ ID NO: 77064
  derived and/or modified sequence opt1 from neuraminidase__InfluenzaA__ABW86609

SEQ ID NO: 77282 - RNA, 1413 nt, Artificial Sequence; identical to SEQ ID NO: 76067
  derived and/or modified sequence opt1 from neuraminidase__InfluenzaA__ABW91188

SEQ ID NO: 77283 - RNA, 1410 nt, Artificial Sequence
  derived and/or modified sequence opt1 from neuraminidase__InfluenzaA__ABW91210
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77284 - RNA, 1413 nt, Artificial Sequence; identical to SEQ ID NO: 77038
  derived and/or modified sequence opt1 from neuraminidase__InfluenzaA__ABW91221

SEQ ID NO: 77285 - RNA, 1410 nt, Artificial Sequence
  derived and/or modified sequence opt1 from neuraminidase__InfluenzaA__ABW91232
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagagcacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaaggagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccgggcacugccucgaccccaacaacgaggagggcgggcacggcgugaaggggugggccuucgacgacggcaacgacgucuggaugggccgcaccaucagcgagaagucccggcugggguacgagacguucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggaccuccggcacguacgggaccggcagcuggcccgacggggccgacaucaaccugaugccgaucuga

SEQ ID NO: 77286 - RNA, 1410 nt, Artificial Sequence; identical to SEQ ID NO: 77074
  derived and/or modified sequence opt1 from neuraminidase__InfluenzaA__ABW91243

SEQ ID NO: 77287 - RNA, 1410 nt, Artificial Sequence; identical to SEQ ID NO: 76892
  derived and/or modified sequence opt1 from neuraminidase__InfluenzaA__ABW91254

SEQ ID NO: 77288 - RNA, 1410 nt, Artificial Sequence; identical to SEQ ID NO: 76892
  derived and/or modified sequence opt1 from neuraminidase__InfluenzaA__ABW91265

SEQ ID NO: 77289 - RNA, 1413 nt, Artificial Sequence; identical to SEQ ID NO: 77038
  derived and/or modified sequence opt1 from neuraminidase__InfluenzaA__ABW91276

SEQ ID NO: 77290 - RNA, 1413 nt, Artificial Sequence
  derived and/or modified sequence opt1 from neuraminidase__InfluenzaA__ABW91287
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacaucuucgugauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcgcccagcccguacaacagccgcuucgaguccgucgccuggagcgccuccgccugccacgacgggaugggcuggcucaccaucggcaucagcgggcccgacaacggcgcgguggccgugcugaaguacaacgggaucaucacggagaccaucaaguccuggaagaagcggauccugcgcacccaggagagcgagugcgucugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcagcugcuacccggacaccgggacggugaugugcgucugccgggacaacuggcacggcuccaaccgccccugggugagcuucaaccagaaccuggacuaccagaucggguacaucugcuccggcguguucggcgacaacccccggcccaaggacggggagggcagcugcaacccggucaccguggacggggcggacggcgugaagggguucuccuacaaguacggcaacggcgucuggaucgggcgcaccaagagcaaccggcugcgcaagggcuucgagaugaucugggaccccaacggguggaccaacacggacuccgacuucagcgugaagcaggacaucguggccaucaccgacugguccggcuacagcgggagcuucguccagcaccccgagcucaccggccuggacugcauccggcccugcuucuggguggagcuggugcgcggccucccgcgggagaacaccacgaucuggaccuccgggagcuccaucagcuucugcggcgucaacuccgggaccgccaacuggagcuggcccgacggcgccgagcugcccuucaccaucgacaaguga

SEQ ID NO: 77291 - RNA, 1413 nt, Artificial Sequence; identical to SEQ ID NO: 77038
  derived and/or modified sequence opt1 from neuraminidase__InfluenzaA__ABW91298

SEQ ID NO: 77292 - RNA, 1413 nt, Artificial Sequence
  derived and/or modified sequence opt1 from neuraminidase__InfluenzaA__ABW91309
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccgacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggcggacggcgccgacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77293 - RNA, 1413 nt, Artificial Sequence; identical to SEQ ID NO: 77038
  derived and/or modified sequence opt1 from neuraminidase__InfluenzaA__ABW91320

SEQ ID NO: 77294 - RNA, 1413 nt, Artificial Sequence; identical to SEQ ID NO: 77038
  derived and/or modified sequence opt1 from neuraminidase__InfluenzaA__ABW91331

SEQ ID NO: 77295 - RNA, 1413 nt, Artificial Sequence; identical to SEQ ID NO: 77038
  derived and/or modified sequence opt1 from neuraminidase__InfluenzaA__ABW91342

SEQ ID NO: 77296 - RNA, 1413 nt, Artificial Sequence; identical to SEQ ID NO: 77038
  derived and/or modified sequence opt1 from neuraminidase__InfluenzaA__ABW91353

SEQ ID NO: 77297 - RNA, 1413 nt, Artificial Sequence
  derived and/or modified sequence opt1 from neuraminidase__InfluenzaA__ABW91364
augaacaccaaccagaagaucaucaccaucggcagcaucuccaucgccaucgggaucaucagccugaugcuccagaucggcaacaucaucuccaucugggccagccacuccauccagacggggagccagaaccacaccggcaucugcaaccagcgcaucaucaccuacgagaacuccaccugggugaaccacacguacgucaacaucaacaacaccaacguggugaccgggaaggacaagaccagcgucacgcuggcgggcaacuccagccugugcuccaucagcggcugggccaucuacaccaaggacaacuccauccggaucgggagcaagggcgacguguucgugauccgcgagcccuucaucuccugcagccaccucgagugccggaccuucuuccugacccagggggcccugcucaacgacaagcacuccaacggcacggucaaggaccgcagcccguaccgggcccugauguccugcccccugggggaggcccccagccccuacaacagcaaguucgaguccguggcguggagcgccuccgccugccacgacggcaugggcuggcucaccaucgggaucagcggcccggacaacggggccguggcgguccugaaguacaacggcaucaucaccgagaccaucaaguccuggaagaagcgcauccugcggacgcaggagagcgagugcgugugcgugaacggcuccugcuucaccaucaugaccgacgggcccagcgacggcgccgccuccuacaagaucuucaagaucgagaaggggaaggucaccaagagcaucgagcucaacgcccccaacuuccacuacgaggagugcuccugcuaccccgacacgggcaccgugaugugcgugugccgcgacaacuggcacgggagcaaccggccgugggucuccuucaaccagaaccuggacuaccagaucggcuacaucugcagcggcguguucggggacaacccccgccccaaggacggcaagggguccugcaaccccgugaccgucgacggcgccgacggggugaagggcuucagcuacaaguacggcaacgggguguggaucggccggaccaaguccaacaagcugcgcaagggguucgagaugaucugggacccgaacggcuggacggacaccgacaacgacuucagcgucaagcaggacgugguggcgaucaccgacugguccggguacagcggcagcuucguccagcaccccgagcucaccggccuggacugcauccggcccugcuucuggguggagcugguccgcgggcucccccgggagaacacgaccaucuggaccuccggcagcuccaucagcuucugcgggguggacuccgacaccgccaacuggagcuggccggacggcgccgagcugcccuucacgaucgacaaguga

SEQ ID NO: 77298 - RNA, 1413 nt, Artificial Sequence; identical to SEQ ID NO: 77038
  derived and/or modified sequence opt1 from neuraminidase__InfluenzaA__ABW91375

SEQ ID NO: 77299 - RNA, 1413 nt, Artificial Sequence; identical to SEQ ID NO: 77064
  derived and/or modified sequence opt1 from neuraminidase__InfluenzaA__ABW91386

SEQ ID NO: 77300 - RNA, 1410 nt, Artificial Sequence
  derived and/or modified sequence opt1 from neuraminidase__InfluenzaA__ABW91397
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcaucugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 77301 - RNA, 1413 nt, Artificial Sequence; identical to SEQ ID NO: 77209
  derived and/or modified sequence opt1 from neuraminidase__InfluenzaA__ABW91408

SEQ ID NO: 77302 - RNA, 1413 nt, Artificial Sequence
  derived and/or modified sequence opt1 from neuraminidase__InfluenzaA__ABW91419
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcgcauccugcggacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccaggugggguacaucugcagcggcguguucggcgacaacccccgccccaaggacgggaagggcuccugcaacccgaugacggucgacggggcggacggcgugaagggguucagcuacaaguacggcaacggcguguggaucgggcggaccaaguccaacaagcugcgcaagggcuucgagaugaucugggaccccaacggguggaccgacaccgacagcgacuucuccgucaagcaggacgugguggccaucacggacuggagcggcuacagcggguccuucguccagcaccccgagcucaccggccuggacugcauccggcccugcuucuggguggagcugguccgcggccucccgcgggagaacaccaccaucuggacgagcggguccagcaucuccuucugcggcguggacagcgacaccgccaacugguccuggcccgacggggccgagcugcccuucaccaucgacaaguga

SEQ ID NO: 77303 - RNA, 1413 nt, Artificial Sequence
  derived and/or modified sequence opt1 from neuraminidase__InfluenzaA__ABW91430
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggguccguggcgguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccaggugggcuacaucugcuccggcguguucggggacaacccccgccccaaggacggcaaggggagcugcaacccgaugacggucgacggcgccgacggggugaagggcuucuccuacaaguacggcaacgggguguggaucggccggaccaagagcaacaagcugcgcaagggguucgagaugaucugggaccccaacggcuggaccgacaccgacuccgacuucagcgucaagcaggacgugguggcgaucacggacuggagcggguacuccggcagcuucguccagcaccccgagcucaccggccuggacugcauccggcccugcuucuggguggagcugguccgcgggcucccgcgggagaacaccaccaucuggacguccggcagcuccaucagcuucugcgggguggacuccgacaccgccaacuggagcuggcccgacggcgccgagcugcccuucaccaucgacaaguga

SEQ ID NO: 77304 - RNA, 1410 nt, Artificial Sequence; identical to SEQ ID NO: 76892
  derived and/or modified sequence opt1 from neuraminidase__InfluenzaA__ABW91441

SEQ ID NO: 77305 - RNA, 1413 nt, Artificial Sequence; identical to SEQ ID NO: 77079
  derived and/or modified sequence opt1 from neuraminidase__InfluenzaA__ABW91452

SEQ ID NO: 77306 - RNA, 1413 nt, Artificial Sequence; identical to SEQ ID NO: 77079
  derived and/or modified sequence opt1 from neuraminidase__InfluenzaA__ABW91463

SEQ ID NO: 77307 - RNA, 1413 nt, Artificial Sequence; identical to SEQ ID NO: 77038
  derived and/or modified sequence opt1 from neuraminidase__InfluenzaA__ABW91474

SEQ ID NO: 77308 - RNA, 1413 nt, Artificial Sequence; identical to SEQ ID NO: 77079
  derived and/or modified sequence opt1 from neuraminidase__InfluenzaA__ABW91485

SEQ ID NO: 77309 - RNA, 1413 nt, Artificial Sequence; identical to SEQ ID NO: 77038
  derived and/or modified sequence opt1 from neuraminidase__InfluenzaA__ABW91496

SEQ ID NO: 77310 - RNA, 1413 nt, Artificial Sequence; identical to SEQ ID NO: 77064
  derived and/or modified sequence opt1 from neuraminidase__InfluenzaA__ABW91507

SEQ ID NO: 77311 - RNA, 1413 nt, Artificial Sequence; identical to SEQ ID NO: 77079
  derived and/or modified sequence opt1 from neuraminidase__InfluenzaA__ABW91518

SEQ ID NO: 77312 - RNA, 1413 nt, Artificial Sequence
  derived and/or modified sequence opt1 from neuraminidase__InfluenzaA__ABW91529
augaaccccaaccagaagaucaucaccaucggcagcaucuccaucgccaucgggaccaucagccugaugcuccagaucggcaacaucaucuccaucugggccagccacuccauccagacggggagccagaaccacaccggcaucugcaaccagcgcaucaucaccuacgagaacuccaccugggugaaccacacguacgucagcaucaacaacaccaacgugguggcggggaaggacaagaccuccgucacccuggccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccaucaaggaccgcucccccuaccgggcccugaugagcugcccccugggggaggcgcccagcccguacaacuccaaguucgagagcgucgccugguccgccagcgccugccacgacggcaugggcuggcucacgaucgggaucuccggccccgacaacggggcgguggccgugcugaaguacaacggcaucaucaccgagaccaucaagagcuggaagaagcgcauccugcggacccaggaguccgagugcgucugcgugaacggcagcugcuucacgaucaugaccgacgggcccuccaacggcgccgccagcuacaagaucuucaagaucgagaaggggaaggugaccaaguccaucgagcucaacgcccccaacuuccacuacgaggagugcagcugcuacccggacaccggcacggucaugugcgugugccgcgacaacuggcacggguccaaccggcccugggugagcuucaaccagaaccuggacuaccagaucggcuacaucugcuccggcgucuucggggacaacccccgccccaaggacggcaaggggagcugcaacccggugaccguggacggcgcggacggggucaagggcuucuccuacaaguacggcaacgggguguggaucggccggaccaagagcaaccgccugcggaagggguucgagaugaucugggaccccaacggcuggaccgacacggacuccgacuucagcgugaagcaggacgucguggccaucaccgacuggagcggguacuccggcagcuucgugcagcaccccgagcucaccggccuggacugcauccgccccugcuucugggucgagcuggugcgggggcucccgcgcgagaacaccacgaucuggaccuccggcagcuccaucagcuucugcggggucgacuccgacaccgccaacuggagcuggcccgacggcgccgagcugcccuucaccaucgacaaguga

SEQ ID NO: 77313 - RNA, 1413 nt, Artificial Sequence
  derived and/or modified sequence opt1 from neuraminidase__InfluenzaA__ABW91540
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccuggaugaaccacaccuacgugagcaucaacaacacgaacgucguggcggggaaggacaagaccuccgugacccuggccggcaacagcucccugugcagcaucuccggcugggccaucuacaccaaggacaacagcauccggaucggguccaagggcgacgucuucgugauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcgucgccugguccgccagcgccugccacgacggcaugggcuggcucaccaucgggaucuccggccccgacaacggggcgguggccgugcugaaguacaacggcaucaucacggagaccaucaagagcuggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccgucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77314 - RNA, 1410 nt, Artificial Sequence
  derived and/or modified sequence opt1 from neuraminidase__InfluenzaA__ABW91551
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaaggagauccugcgcacccaggaguccgagugcgucugcaucaacggcacgugcaccguggugaugaccgacgggagcgccuccggcaaggccgacaccaagauccucuucaucgaggagggcaagaucguccacacgagcacccugagcggguccgcgcagcacguggaggagugcagcugcuacccccgguaccccggcgugcgcugcgucugccgggacaacuggaagggguccaaccgcccgaucguggacaucaacaucaaggaccacagcaucguguccagcuacgucugcuccggccuggugggcgacacgccccggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccccaagagcaagcugcagaucaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcaccagcgggacguacggcaccggguccuggccggacggcgccgacaucaaccugaugcccaucuga

SEQ ID NO: 77315 - RNA, 1413 nt, Artificial Sequence; identical to SEQ ID NO: 77038
  derived and/or modified sequence opt1 from neuraminidase__InfluenzaA__ABW91562

SEQ ID NO: 77316 - RNA, 1413 nt, Artificial Sequence; identical to SEQ ID NO: 77073
  derived and/or modified sequence opt1 from neuraminidase__InfluenzaA__ABW91584

SEQ ID NO: 77317 - RNA, 1413 nt, Artificial Sequence; identical to SEQ ID NO: 77038
  derived and/or modified sequence opt1 from neuraminidase__InfluenzaA__ABW91595

SEQ ID NO: 77318 - RNA, 1413 nt, Artificial Sequence; identical to SEQ ID NO: 77079
  derived and/or modified sequence opt1 from neuraminidase__InfluenzaA__ABW91606

SEQ ID NO: 77319 - RNA, 1413 nt, Artificial Sequence; identical to SEQ ID NO: 77073
  derived and/or modified sequence opt1 from neuraminidase__InfluenzaA__ABW91617

SEQ ID NO: 77320 - RNA, 1413 nt, Artificial Sequence; identical to SEQ ID NO: 77038
  derived and/or modified sequence opt1 from neuraminidase__InfluenzaA__ABW91628

SEQ ID NO: 77321 - RNA, 1413 nt, Artificial Sequence; identical to SEQ ID NO: 77038
  derived and/or modified sequence opt1 from neuraminidase__InfluenzaA__ABW91639

SEQ ID NO: 77322 - RNA, 1410 nt, Artificial Sequence; identical to SEQ ID NO: 76892
  derived and/or modified sequence opt1 from neuraminidase__InfluenzaA__ABW91650

SEQ ID NO: 77323 - RNA, 1350 nt, Artificial Sequence
  derived and/or modified sequence opt1 from neuraminidase__InfluenzaA__ABX10517
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaacuuccugaccgagaaggccguggcgagcgucaagcucgccggcaacuccagccugugccccaucaacgggugggccgugcacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacaacggcgccguggcggugcugaaguacaacgggaucaucaccgacaccaucaaguccuggcgcaacaacauccuccggacccaggagagcgagugcgccugcgucaacggcuccugcuucacggugaugaccgacgggccgagcaacggccaggccucccacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcucaccgggcuggacugcauccggcccugcuucugggucgagcugauccgcggccggcccaaggaguccaccaucugggccagcggcuccagcaucuccuucugcggggugaacagcgacaccgugggcugguccuggcccgacggggccgagcucccguucacgaucgacaaguga

SEQ ID NO: 77324 - RNA, 1410 nt, Artificial Sequence; identical to SEQ ID NO: 76937
  derived and/or modified sequence opt1 from neuraminidase__InfluenzaA__ABX10527

SEQ ID NO: 77325 - RNA, 1413 nt, Artificial Sequence
  derived and/or modified sequence opt1 from neuraminidase__InfluenzaA__ABX58242
augaaccccaaccagaagaucaucaccaucggcagcaucuccaucgccaucgggaucaucagccugaugcuccagaucggcaacaucaucuccaucuggaccagccacuccauccagacggggagccagaaccacaccggcaucugcaaccagcgcaucaucaccuacgagaacuccaccugggugaaccacacguacgucagcaucaacaacaccaacgugguggccgggaaggacaagaccuccgucacccuggcgggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcccccagcccguacaacuccaaguucgagagcguggcgugguccgccagcgccugccacgacggcaugggcuggcucacgaucgggaucuccggccccgacaacggggccguggcgguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggagcggguacuccggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 77326 - RNA, 1413 nt, Artificial Sequence; identical to SEQ ID NO: 77137
  derived and/or modified sequence opt1 from neuraminidase__InfluenzaA__ABX58253

SEQ ID NO: 77327 - RNA, 1413 nt, Artificial Sequence; identical to SEQ ID NO: 77038
  derived and/or modified sequence opt1 from neuraminidase__InfluenzaA__ABX58264

SEQ ID NO: 77328 - RNA, 1413 nt, Artificial Sequence; identical to SEQ ID NO: 77038
  derived and/or modified sequence opt1 from neuraminidase__InfluenzaA__ABX58275

SEQ ID NO: 77329 - RNA, 1413 nt, Artificial Sequence; identical to SEQ ID NO: 77038
  derived and/or modified sequence opt1 from neuraminidase__InfluenzaA__ABX58286

SEQ ID NO: 77330 - RNA, 1413 nt, Artificial Sequence
  derived and/or modified sequence opt1 from neuraminidase__InfluenzaA__ABX58297
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagaagaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcggauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcaaggggagcugcaacccggugacggucgacggcgcggacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccggcccugcuucuggguggagcugguccgcgggcucccgcgggagaacaccaccaucuggacguccggcagcuccaucagcuucugcgggguggacuccgacaccgccaacuggagcuggcccgacggcgccgagcugcccuucaccaucgacaaguga

SEQ ID NO: 77331 - RNA, 1413 nt, Artificial Sequence; identical to SEQ ID NO: 77209
  derived and/or modified sequence opt1 from neuraminidase__InfluenzaA__ABX58308

SEQ ID NO: 77332 - RNA, 1413 nt, Artificial Sequence
  derived and/or modified sequence opt1 from neuraminidase__InfluenzaA__ABX58319
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccaucaaggaccgcucccccuaccgggcccugaugagcugcccccugggggaggcgcccagcccguacaacuccaaguucgagagcgucgccugguccgccagcgccugccacgacggcaugggcuggcucaccaucgggaucuccggccccgacaacggggcgguggccgugcugaaguacaacggcaucaucacggagaccaucaagagcuggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccaucgagcucaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggagcugcaacccggugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77333 - RNA, 1413 nt, Artificial Sequence; identical to SEQ ID NO: 77209
  derived and/or modified sequence opt1 from neuraminidase__InfluenzaA__ABX58352

SEQ ID NO: 77334 - RNA, 1413 nt, Artificial Sequence; identical to SEQ ID NO: 77038
  derived and/or modified sequence opt1 from neuraminidase__InfluenzaA__ABX58363

SEQ ID NO: 77335 - RNA, 1413 nt, Artificial Sequence; identical to SEQ ID NO: 77038
  derived and/or modified sequence opt1 from neuraminidase__InfluenzaA__ABX58385

SEQ ID NO: 77336 - RNA, 1413 nt, Artificial Sequence; identical to SEQ ID NO: 77038
  derived and/or modified sequence opt1 from neuraminidase__InfluenzaA__ABX58396

SEQ ID NO: 77337 - RNA, 1413 nt, Artificial Sequence
  derived and/or modified sequence opt1 from neuraminidase__InfluenzaA__ABX58407
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcccgaucagcggcugggccaucuacaccaaggacaacuccauccggaucgggagcaagggcgacguguucgugauccgcgagcccuucaucuccugcagccaccucgagugccggacguucuuccugacccagggggcccugcucaacgacaagcacuccaacggcaccgucaaggaccgcagccccuaccgggcccugauguccugcccccugggggaggcgccgagccccuacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgccccgaacuuccacuacgaggagugcuccugcuaccccgacaccggcaccgugaugugcgugugccgcgacaacuggcacgggagcaaccggcccugggucuccuucaaccagaaccuggacuaccagaucggcuacaucugcagcggcguguucggggacaacccccgcccgaaggacggcaagggguccugcaaccccgugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgcccgugcuucuggguggagcugguccgggggcucccccgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77338 - RNA, 1413 nt, Artificial Sequence; identical to SEQ ID NO: 77079
  derived and/or modified sequence opt1 from neuraminidase__InfluenzaA__ABX58418

SEQ ID NO: 77339 - RNA, 1413 nt, Artificial Sequence; identical to SEQ ID NO: 77038
  derived and/or modified sequence opt1 from neuraminidase__InfluenzaA__ABX58429

SEQ ID NO: 77340 - RNA, 1413 nt, Artificial Sequence; identical to SEQ ID NO: 77038
  derived and/or modified sequence opt1 from neuraminidase__InfluenzaA__ABX58440

SEQ ID NO: 77341 - RNA, 1413 nt, Artificial Sequence
  derived and/or modified sequence opt1 from neuraminidase__InfluenzaA__ABX58451
augaaccccaaccagaagaucaucaccaucggcagcaucuccaucgccaucgggaccaucagccugaugcuccagaucggcaacaucaucuccaucugggccagccacuccauccagacggggagccagaaccacaccggcaucugcaaccagcgcaucaucaccuacgagaacuccaccugggugaaccacacguacgucagcaucaacaacaccaacgugguggcggggaaggacaagaccuccgucacccuggccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggccaucaccgacuggagcggguacuccggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 77342 - RNA, 1413 nt, Artificial Sequence; identical to SEQ ID NO: 77079
  derived and/or modified sequence opt1 from neuraminidase__InfluenzaA__ABX58462

SEQ ID NO: 77343 - RNA, 1413 nt, Artificial Sequence; identical to SEQ ID NO: 77038
  derived and/or modified sequence opt1 from neuraminidase__InfluenzaA__ABX58473

SEQ ID NO: 77344 - RNA, 1413 nt, Artificial Sequence; identical to SEQ ID NO: 77079
  derived and/or modified sequence opt1 from neuraminidase__InfluenzaA__ABX58484

SEQ ID NO: 77345 - RNA, 1413 nt, Artificial Sequence
  derived and/or modified sequence opt1 from neuraminidase__InfluenzaA__ABX58495
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaaccgcaccgucaaggaccggucccccuaccgcgcccugaugagcugcccccugggcgaggcgcccagcccguacaacuccaaguucgagagcguggccugguccgccagcgccugccacgacgggaugggcuggcucaccaucggcaucuccgggcccgacaacggcgcgguggccguccugaaguacaacgggaucaucacggagaccaucaagagcuggaagaagcggauccugcgcacccaggaguccgagugcgugugcgugaacggcagcugcuucaccaucaugacggacggccccuccaacggggccgccagcuacaagaucuucaagaucgagaagggcaaggucaccaaguccaucgagcucaacgcccccaacuuccacuacgaggagugcagcugcuacccggacaccgggaccgugaugugcgugugccgggacaacuggcacggcuccaaccgccccugggucagcuucaaccagaaccuggacuaccagaucggguacaucugcuccggcguguucggcgacaacccccggcccaaggacgggaagggcagcugcaacccggugacggucgacggggcggacggcgugaagggguucuccuacaaguacggcaacggcguguggaucgggcgcaccaagagcaaccggcugcgcaagggcuucgagaugaucugggaccccaacggguggaccgacaccgacuccgacuucagcgucaagcaggacgugguggccaucacggacuggagcggcuacuccgggagcuucguccagcaccccgagcucaccggccuggacugcauccggcccugcuucuggguggagcugguccgcggccucccgcgggagaacaccaccaucuggacguccgggagcuccaucagcuucugcggcguggacuccgacaccgccaacuggagcuggcccgacggggccgagcugcccuucaccaucgacaaguga

SEQ ID NO: 77346 - RNA, 1413 nt, Artificial Sequence; identical to SEQ ID NO: 77073
  derived and/or modified sequence opt1 from neuraminidase__InfluenzaA__ABX58506

SEQ ID NO: 77347 - RNA, 1413 nt, Artificial Sequence; identical to SEQ ID NO: 77079
  derived and/or modified sequence opt1 from neuraminidase__InfluenzaA__ABX58528

SEQ ID NO: 77348 - RNA, 1413 nt, Artificial Sequence; identical to SEQ ID NO: 77079
  derived and/or modified sequence opt1 from neuraminidase__InfluenzaA__ABX58539

SEQ ID NO: 77349 - RNA, 1413 nt, Artificial Sequence
  derived and/or modified sequence opt1 from neuraminidase__InfluenzaA__ABX58550
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccguggacaaguga

SEQ ID NO: 77350 - RNA, 1413 nt, Artificial Sequence; identical to SEQ ID NO: 77038
  derived and/or modified sequence opt1 from neuraminidase__InfluenzaA__ABX58561

SEQ ID NO: 77351 - RNA, 1413 nt, Artificial Sequence
  derived and/or modified sequence opt1 from neuraminidase__InfluenzaA__ABX58572
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccgaugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77352 - RNA, 1413 nt, Artificial Sequence; identical to SEQ ID NO: 77038
  derived and/or modified sequence opt1 from neuraminidase__InfluenzaA__ABX58583

SEQ ID NO: 77353 - RNA, 1413 nt, Artificial Sequence; identical to SEQ ID NO: 77038
  derived and/or modified sequence opt1 from neuraminidase__InfluenzaA__ABX58594

SEQ ID NO: 77354 - RNA, 1413 nt, Artificial Sequence; identical to SEQ ID NO: 77064
  derived and/or modified sequence opt1 from neuraminidase__InfluenzaA__ABX58605

SEQ ID NO: 77355 - RNA, 1413 nt, Artificial Sequence; identical to SEQ ID NO: 77064
  derived and/or modified sequence opt1 from neuraminidase__InfluenzaA__ABX58616

SEQ ID NO: 77356 - RNA, 1413 nt, Artificial Sequence; identical to SEQ ID NO: 77038
  derived and/or modified sequence opt1 from neuraminidase__InfluenzaA__ABX58627

SEQ ID NO: 77357 - RNA, 1413 nt, Artificial Sequence; identical to SEQ ID NO: 77038
  derived and/or modified sequence opt1 from neuraminidase__InfluenzaA__ABX58638

SEQ ID NO: 77358 - RNA, 1413 nt, Artificial Sequence
  derived and/or modified sequence opt1 from neuraminidase__InfluenzaA__ABX58682
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccaugaugugcgugugccgcgacaacuggcacggguccaaccggcccugggugagcuucaaccagaaccuggacuaccagaucggcuacaucugcuccggcgucuucggggacaacccccgccccaaggacggcaaggggagcugcaacccggugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77359 - RNA, 1413 nt, Artificial Sequence
  derived and/or modified sequence opt1 from neuraminidase__InfluenzaA__ABX58693
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcagcggcguccugggggacaacccccgccccgaggacggcgagggguccugcaacccggugaccguggacggcgcggacggggucaagggcuucagcuacaaguacgacaacggcguguggaucgggcggacgaaguccaaccgccuccggaagggcuucgagaugaucugggaccccaacggguggaccaacaccgacagcgacuucuccgugaagcaggacgucguggccaucaccgacuggagcggcuacagcggguccuucgugcagcaccccgagcugacgggccuggacugcauccgccccugcuucugggucgagcucgugcggggccugccgcgcgagaacaccaccaucuggaccagcggguccagcaucuccuucugcggcgucaacagcgacacggccaacugguccuggcccgacggggccgagcugcccuucaccaucgacaaguga

SEQ ID NO: 77360 - RNA, 1413 nt, Artificial Sequence; identical to SEQ ID NO: 77209
  derived and/or modified sequence opt1 from neuraminidase__InfluenzaA__ABX58704

SEQ ID NO: 77361 - RNA, 1413 nt, Artificial Sequence; identical to SEQ ID NO: 77137
  derived and/or modified sequence opt1 from neuraminidase__InfluenzaA__ABX58715

SEQ ID NO: 77362 - RNA, 1350 nt, Artificial Sequence
  derived and/or modified sequence opt1 from neuraminidase__InfluenzaA__ABY19420
augaaccccaaccagaaggugaucaccaucggcagcaucugcauggucaucgggaucgugucccugaugcuccagaucggcaacaugaucagcaucugggugucccacagcauccagaccgggaaccagaaccaggucgagccgaucaucaacacgaacuuccugaccggcaaggccguggccuccaucacccuggcggggaacagcucccucugccccauccgcggcugggccauccacagcaaggacaacuccauccggaucggcagcaagggggacguguucgucauccgcgagcccuucaucuccugcagccaccuggagugccggaccuucuuccugacgcagggcgcccuccugaacgacaagcacuccaacgggaccgugaaggaccgcagcccccaccggacccugauguccugcccggugggcgaggcccccagccccuacaacucccgcuucgagagcgucgccugguccgcgagcgccugccacgacgggaccagcuggcucacgaucggcaucuccggccccgacaacggggccguggccgugcugaaguacaacggcaucaucaccgacaccaucaagagcuggcggaacaacauccugcgcacccaggaguccgagugcgcgugcgucaacgggagcugcuucacggugaugaccgacggcccguccaacggccaggccagcuacaagaucuucaagauggagaaggggaaggugaucaaguccgucgagcucgacgcccccaacuaccacuacgaggagugcagcugcuaccccgacgccggcgagaucacgugcgugugccgggacaacuggcacggguccaaccgccccugggugagcuucaaccagaaccuggaguaccagaucggcuacaucugcuccggggucuucggcgacaacccgcggcccaacgacggcaccgggagcugcggccccgugucccacaacggggccuacggcgugaagggguucagcuucaaguacggcaacggcgucuggaucgggcgcaccaagucccccaacagccgguccggcuucgagaugaucugggacccgaacggguggagcgagaccgacuccagcuucagcgugaagcaggacaucguggcgaucaccgacugguccggcuacagcggguccuucguccagcaccccgagcugaccggccucgacugcauccgccccugcuucuggguggagcugauccggggccgccccaaggagagcacggucuggaccuccgggagcuccaucagcuucugcggcgugaacuccgacaccgugagcugguccuggccggacggggccgagcugcccuucagcaucgacaaguga

SEQ ID NO: 77363 - RNA, 1350 nt, Artificial Sequence
  derived and/or modified sequence opt1 from neuraminidase__InfluenzaA__ABY19421
augaaccccaaccagaagaucaucaccaucggcagcaucugcauggugaucgggaucgucucccugaugcuccagaucggcaacaugaucagcaucugggugucccacagcauccagaccgggaaccagaaccagguggagccgaucaucaacacgaacuuccugaccggcaaggccgucgccuccaucacccuggcggggaacagcucccucugccccauccgcggcugggccauccacagcaaggacaacuccauccggaucggcagcaagggggacguguucgugauccgcgagcccuucaucuccugcagccaccuggagugccggaccuucuuccugacgcagggcgcccuccugaacgacaagcacuccaacgggaccgucaaggaccgcagcccccaccggacccugauguccugcccggugggcgaggcccccagccccuacaacucccgcuucgagagcguggccugguccgcgagcgccugccacgacgggaccagcuggcucacgaucggcaucuccggccccgacaacggggccgucgccgugcugaaguacaacggcaucaucaccgacaccaucaagagcuggcggaacaacauccugcgcacccaggaguccgagugcgcgugcgugaacgggagcugcuucacggucaugaccgacggcccguccaacggccaggccagcuacaagaucuucaagauggagaaggggaaggugaucaaguccguggagcucgacgcccccaacuaccacuacgaggagugcagcugcuaccccgacgccggcgagaucacgugcgucugccgggacaacuggcacggguccaaccgccccugggugagcuucaaccagaaccuggaguaccagaucggcuacaucugcuccgggguguucggcgacaacccgcggcccaacgacggcaccgggagcugcggccccgucucccacaacggggccuacggcgugaagggguucagcuucaaguacggcaacggcguguggaucgggcgcaccaagucccccaacagccgguccggcuucgagaugaucugggacccgaacggguggagcgagaccgacuccagcuucagcgucaagcaggacaucguggcgaucaccgacugguccggcuacagcggguccuucgugcagcaccccgagcugaccggccucgacugcauccgccccugcuucugggucgagcugauccggggccgccccaaggagagcacgguguggaccuccgggagcuccaucagcuucugcggcgucaacuccgacaccgugagcugguccuggccggacggggccgagcugcccuucagcaucgacaaguga

SEQ ID NO: 77364 - RNA, 1413 nt, Artificial Sequence
  derived and/or modified sequence opt1 from neuraminidase__InfluenzaA__ABY51020
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccgcugacgguggacggcgcggacggggucaagggcuucuccuacaaguacggcaacgggguguggaucggccggaccaagagcaaccgccuccggaagggguucgagaugaucugggaccccaacggcuggaccgacaccgacuccgacuucagcgugaagcaggacgucguggccaucacggacuggagcggguacuccggcagcuucgugcagcaccccgagcugaccggccuggacugcauccgccccugcuucugggucgagcucgugcgggggcugccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77365 - RNA, 1410 nt, Artificial Sequence; identical to SEQ ID NO: 77074
  derived and/or modified sequence opt1 from neuraminidase__InfluenzaA__ABY51031

SEQ ID NO: 77366 - RNA, 1413 nt, Artificial Sequence
  derived and/or modified sequence opt1 from neuraminidase__InfluenzaA__ABY51042
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugaccguggacggcgcggacggggucaagggcuucagcuacaaguacgacaacggcguguggaucgggcggacgaaguccaaccgccugcggaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccgccccugcuucugggucgagcuggugcggggccucccgcgcgagaacaccaccaucuggaccagcggguccagcaucuccuucugcggcgucaacagcgacacggccaacugguccuggcccgacggggccgagcugcccuucaccaucgacaaguga

SEQ ID NO: 77367 - RNA, 1413 nt, Artificial Sequence
  derived and/or modified sequence opt1 from neuraminidase__InfluenzaA__ABY51053
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcagcggcgucuucggggacaacccccgccccgaggacggcgagggguccugcaacccggugaccguggacggcacggacggggucaagggcuucagcuacaaguacgacaacggcguguggaucgggcggaccaaguccaaccgccugcggaagggcuucgagaugaucugggaccccaacggguggaccaacaccgacagcgacuucuccgugaagcaggacgucguggcgaucacggacuggagcggcuacagcggguccuucgugcagcaccccgagcucaccggccuggacugcauccgccccugcuucugggucgagcuggugcggggccucccgcgcgagaacaccaccaucuggacgagcggguccagcaucuccuucugcggcgucaacagcgacaccgccaacugguccuggcccgacggggccgagcugcccuucaccaucgacaaguga

SEQ ID NO: 77368 - RNA, 1413 nt, Artificial Sequence; identical to SEQ ID NO: 77137
  derived and/or modified sequence opt1 from neuraminidase__InfluenzaA__ABY51064

SEQ ID NO: 77369 - RNA, 1413 nt, Artificial Sequence; identical to SEQ ID NO: 77038
  derived and/or modified sequence opt1 from neuraminidase__InfluenzaA__ABY51075

SEQ ID NO: 77370 - RNA, 1413 nt, Artificial Sequence
  derived and/or modified sequence opt1 from neuraminidase__InfluenzaA__ABY51086
augaaccccaaccagaagaucaucaccaucggcagcaucuccaucgccaucgggaucaucagcaucaugcugcagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggagaaggacaagaccagcgucacccucgccgggaacuccagccugugcuccaucagcggcugggccaucuacaccaaggacaacuccauccggaucggcagcaagggggacguguucgugauccgcgagccguucaucuccugcagccaccuggagugccggacguucuuccucacccagggcgcccugcugaacgacaagcacuccaacgggaccgucaaggaccgcagccccuaccgggcccucauguccugcccccugggcgaggcgcccagcccguacaacagcaaguucgaguccguggccuggagcgccuccgccugccacgacgggaugggcuggcugaccaucggcaucagcgggcccgacaacggcgcgguggccguccucaaguacaacgggaucaucacggagaccaucaaguccuggaagaagcgcauccugcggacccaggagagcgagugcgugugcgugaacggcuccugcuucaccaucaugacggacggccccagcaacggggccgccuccuacaagaucuucaagaucgagaagggcaaggucaccaagagcaucgagcugaacgcccccaacuuccacuacgaggagugcuccugcuacccggacaccgggaccgugaugugcgugugccgcgacaacuggcacggcagcaaccggcccugggucuccuucaaccagaaccucgacuaccagaucggguacaucugcagcggcguguucggcgacaacccccgccccaaggacgggaagggcuccugcaacccggugacggucgacggggcggacggcaucaagggguucagcuacaaguacggcaacggcguguggaucgggcggaccaaguccaaccgccugcggaagggcuucgagaugaucugggaccccaacggguggaccaacaccgacagcgacuucuccgugaagcaggacgucguggccaucacggacuggagcggcuacagcggguccuucgugcagcaccccgagcugaccggccucgacugcauccgccccugcuucugggucgagcuggugcggggccugccgcgcgagaacaccaccaucuggacgagcggguccagcaucuccuucugcggcgucgacggggacaccgccaacuggagcuggcccgacggcgccgagcuccccuucaccaucgacaaguga

SEQ ID NO: 77371 - RNA, 1413 nt, Artificial Sequence
  derived and/or modified sequence opt1 from neuraminidase__InfluenzaA__ABY51097
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccguggagcucaacgcccccaacuuccacuacgaggagugcagcugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggagcugcaacccggucacgguggacggcgcggacggggugaagggcuucuccuacaaguacggcaacggggucuggaucggccggaccaagagcaaccgccugcggaagggguucgagaugaucugggaccccaacggcuggaccgacaccgacuccgacuucagcgugaagcaggacguggucgccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77372 - RNA, 1413 nt, Artificial Sequence
  derived and/or modified sequence opt1 from neuraminidase__InfluenzaA__ABY51108
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacaucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77373 - RNA, 1413 nt, Artificial Sequence; identical to SEQ ID NO: 77038
  derived and/or modified sequence opt1 from neuraminidase__InfluenzaA__ABY51119

SEQ ID NO: 77374 - RNA, 1410 nt, Artificial Sequence; identical to SEQ ID NO: 76892
  derived and/or modified sequence opt1 from neuraminidase__InfluenzaA__ABY51130

SEQ ID NO: 77375 - RNA, 1413 nt, Artificial Sequence; identical to SEQ ID NO: 77079
  derived and/or modified sequence opt1 from neuraminidase__InfluenzaA__ABY51141

SEQ ID NO: 77376 - RNA, 1413 nt, Artificial Sequence
  derived and/or modified sequence opt1 from neuraminidase__InfluenzaA__ABY51152
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 77377 - RNA, 1413 nt, Artificial Sequence
  derived and/or modified sequence opt1 from neuraminidase__InfluenzaA__ABY51163
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucauccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacagcgacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccagcggcuccagcaucuccuucugcgggguggacagcgacacggccaacugguccuggcccgacggcgccgagcugcccuucaccaucgacaaguga

SEQ ID NO: 77378 - RNA, 1413 nt, Artificial Sequence
  derived and/or modified sequence opt1 from neuraminidase__InfluenzaA__ABY51174
augaaccccaaccagaagaugaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 77379 - RNA, 1413 nt, Artificial Sequence; identical to SEQ ID NO: 77038
  derived and/or modified sequence opt1 from neuraminidase__InfluenzaA__ABY51185

SEQ ID NO: 77380 - RNA, 1413 nt, Artificial Sequence; identical to SEQ ID NO: 77073
  derived and/or modified sequence opt1 from neuraminidase__InfluenzaA__ABY51196

SEQ ID NO: 77381 - RNA, 1410 nt, Artificial Sequence; identical to SEQ ID NO: 77074
  derived and/or modified sequence opt1 from neuraminidase__InfluenzaA__ABY51229

SEQ ID NO: 77382 - RNA, 1413 nt, Artificial Sequence
  derived and/or modified sequence opt1 from neuraminidase__InfluenzaA__ABY51240
augaaccccaaccagaagaucaucaccaucggcagcaucuccaucgccaucgggaucaucagccugaugcuccagaucggcaacaucaucuccgugugggccagccacuccauccagaccgggagccagaaccacacgggcaucugcaaccagcgcaucaucaccuacgagaacuccaccugggucaaccacaccuacgugagcaucaacaacacgaacguggucgcggggaaggacaagaccuccgugacccuggccggcaacagcucccugugcagcaucuccggcuggagcaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugaugagcugcccccugggggaggcccccuccccguacaacagcaaguucgaguccguggcguggagcgccuccgccugccacgacggcaugggcuggcucaccaucgggaucagcggccccgacaacggggccgucgcggugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcaagggguccugcaacccggucacgguggacggcgccgacggggugaagggcuucagcuacaaguacggcaacggggucuggaucggccggaccaaguccaaccgccugcggaagggguucgagaugaucugggaccccaacggcuggaccgacaccgacagcgacuucagcgugaagcaggacguggucgcgaucacggacugguccggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77383 - RNA, 1413 nt, Artificial Sequence; identical to SEQ ID NO: 77064
  derived and/or modified sequence opt1 from neuraminidase__InfluenzaA__ABY51251

SEQ ID NO: 77384 - RNA, 1413 nt, Artificial Sequence
  derived and/or modified sequence opt1 from neuraminidase__InfluenzaA__ABY51262
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacgccaccaucuggaccuccggcagcuccaucagcuucugcgggguggacuccgacacggccaacuggagcuggcccgacggcgccgagcugcccuucaccaucgacaaguga

SEQ ID NO: 77385 - RNA, 1410 nt, Artificial Sequence; identical to SEQ ID NO: 76892
  derived and/or modified sequence opt1 from neuraminidase__InfluenzaA__ABY51273

SEQ ID NO: 77386 - RNA, 1350 nt, Artificial Sequence
  derived and/or modified sequence opt1 from neuraminidase__InfluenzaA__ABY76285
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagcaagggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccaacggccaggccagcuacaagaucuucaagauggagaagggcaagguggucaaguccguggagcucgacgcccccaacuaccacuacgaggagugcagcugcuaccccgacgccggggagaucacgugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccgugucccccaacggcgcguacggggucaagggcuucagcuucaaguacgggaacggcguguggaucggccgcaccaaguccaccaacagccgguccggguucgagaugaucugggacccgaacggcuggaccgggaccgacagcagcuucuccgugaagcaggacaucgucgccaucacggacuggagcggcuacuccgggagcuucgugcagcaccccgagcugaccggccucgacugcauccgccccugcuucugggucgagcugauccggggccgccccaaggaguccaccaucuggaccagcggguccagcaucuccuucugcggcgugaacagcgacacgguguccuggagcuggccggacggggccgagcugcccuucaccaucgacaaguga

SEQ ID NO: 77387 - RNA, 1413 nt, Artificial Sequence
  derived and/or modified sequence opt1 from neuraminidase__InfluenzaA__ABY81352
augaaccccaaccagaagaucaucaccaucggcagcaucugcauggccaucgggaucaucucccugauccuccagaucggcagcaucaucuccaucugggugagccacuccauccagaccgggagccagaaccacacgggcaucugcaaccagcgcaucaucaccuacgagaacuccaccugggucaaccagaccuacgugaacaucagcaacacgaacguggucgccgggaaggacaccaccuccaugacccuggcgggcaacagcucccugugcccgauccggggcugggccaucuacagcaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugccccaucggggaggccccgagccccuacaacagccgguucgaguccguggcguggagcgccuccgccugccacgacggcaugggcuggcugaccaucgggaucagcggccccgacgacggggccguggcgguccucaaguacaacggcaucaucacggagaccaucaaguccuggcgcaagcagauccugcggacccaggagagcgagugcgugugcgugaacggcuccugcuucaccaucaugacggacgggcccagcgacggccaggccuccuaccgcaucuucaagaucgagaaggggaagaucaccaagagcaucgagcuggacgccccgaacucccacuacgaggagugcagcugcuaccccgacaccggcaccgucaugugcgugugccgggacaacuggcacggguccaaccgccccugggugagcuucaaccagaaccucgacuaccagaucggcuacaucugcuccggcgucuucggggacaacccccggccgaaggacggcaaggggagcugcgaccccgugaacguggacggcgccgacggggucaagggcuucuccuaccgcuacggcaacgggguguggaucggccggaccaagagcaacuccagccgcaagggguucgagaugaucugggaccccaacggcuggacggacaccgacagcaacuuccuggugaagcaggacgucguggccaugaccgacugguccggguacagcggcuccuucgugcagcaccccgagcugacgggccucgacugcaugcggccgugcuucugggucgagcugauccgcgggcggccccgcgagaagaccaccaucuggaccagcggcuccagcaucuccuucugcggggugaacagcgacacggucaacugguccuggcccgacggcgcggagcugcccuucaccaucgacaaguga

SEQ ID NO: 77388 - RNA, 1413 nt, Artificial Sequence
  derived and/or modified sequence opt1 from neuraminidase__InfluenzaA__ABY81363
augaaccccaaccagaagaucaucaccaucggcagcaucuccaucgccaucgggaucaucagccugaugcuccagaucggcaacaucaucuccaucugggccagccacuccauccagaucgggagccagaaccacaccggcaucugcaaccagcgcaucaucacguacgagaacuccaccugggugaaccacaccuacgucagcaucaacaacaccaacgugguggcggggaaggacaagacguccgucacccuggccggcaacagcucccugugcagcaucuccggcugggccaucuacaccaaggacaacagcauccggaucggguccaagggcgacguguucgugauccgcgagccguucaucagcugcucccaccucgagugccggaccuucuuccugacgcagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucaccgagacgaucaagagcuggaagaagcgcauccugcggacccaggaguccgagugcgugugcgugaacggcagcugcuucaccaucaugaccgacgggcccuccaacggcgccgccagcuacaagaucuucaagaucgagaaggggaaggucacgaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucagcgucaagcaggacgugguggccaucaccgacuggagcggguacuccggcagcuucguccagcaccccgagcucacgggccuggacugcauccgccccugcuucuggguggagcugguccgggggcucccgcgcgagaacaccaccaucuggaccuccggcagcuccaucagcuucugcgggguggacuccgacacggccaacuggagcuggcccgacggcgccgagcugcccuucaccaucgacaaguga

SEQ ID NO: 77389 - RNA, 1410 nt, Artificial Sequence; identical to SEQ ID NO: 77074
  derived and/or modified sequence opt1 from neuraminidase__InfluenzaA__ABY81374

SEQ ID NO: 77390 - RNA, 1413 nt, Artificial Sequence; identical to SEQ ID NO: 77038
  derived and/or modified sequence opt1 from neuraminidase__InfluenzaA__ABY81385

SEQ ID NO: 77391 - RNA, 1413 nt, Artificial Sequence
  derived and/or modified sequence opt1 from neuraminidase__InfluenzaA__ABY81407
augaaccccaaccagaagaucaucaccaucggcagcaucuccaucgccaucgggaccaucagccugaugcuccagaucggcaacaucaucuccaucugggccagccacuccauccagacggggagccagaaccacaccggcaucugcaaccagcgcaucaucaccuacgagaacuccaccugggugaaccacacguacgucagcaucaacaacaccaacgugguggcggggaaggacaagaccuccgucacccuggccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggaccgacacggacuccgacuuccucgucaagcaggacgugguggccaucaccgacuggagcggguacagcggcuccuucguccagcaccccgagcugaccggccuggacugcauccgccccugcuucuggguggagcucguccgggggcugccgcgcgagaacaccacgaucuggaccagcggcuccagcaucuccuucugcgggguggacagcgacaccgccaacugguccuggcccgacggcgccgagcugcccuucaccaucgacaaguga

SEQ ID NO: 77392 - RNA, 1410 nt, Artificial Sequence; identical to SEQ ID NO: 77074
  derived and/or modified sequence opt1 from neuraminidase__InfluenzaA__ACA24505

SEQ ID NO: 77393 - RNA, 1413 nt, Artificial Sequence; identical to SEQ ID NO: 77038
  derived and/or modified sequence opt1 from neuraminidase__InfluenzaA__ACA24516

SEQ ID NO: 77394 - RNA, 1413 nt, Artificial Sequence; identical to SEQ ID NO: 77038
  derived and/or modified sequence opt1 from neuraminidase__InfluenzaA__ACA24527

SEQ ID NO: 77395 - RNA, 1410 nt, Artificial Sequence
  derived and/or modified sequence opt1 from neuraminidase__InfluenzaA__ACA24692
augaaccccaaccagaagaucaucaccaucggcagcgugucccugaccaucagcacgaucugcuucuucaugcagaucgccauccucaucaccaccgucacccugcacuucaagcaguacgaguucuccccgccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuacccgggcguccggugcgugugccgcgacaacuggaaggggagcaaccggcccaucguggacaucaacaucaaggacuacuccaucgucagcaaguacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagucccgcagcggcuacgagaccuucaaggucaucgagggguggagcaacccgaacuccaagcugcagaucaaccgccaggugaucguggaccggggcaaccggagcggguacuccggcaucuucagcgucgagggcaagagcugcaucaaccgcugcuucuacguggagcugauccgggggcgcaacgaggagaccgaggugcucuggaccuccaacagcaucgucguguucugcggcaccuccgggacguacggcaccgggagcuggcccgacggcgccgacaucaaccugaugcccaucuga

SEQ ID NO: 77396 - RNA, 1410 nt, Artificial Sequence
  derived and/or modified sequence opt1 from neuraminidase__InfluenzaA__ACA24703
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaucaccaucgagaaggagacgugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaacgccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 77397 - RNA, 1413 nt, Artificial Sequence
  derived and/or modified sequence opt1 from neuraminidase__InfluenzaA__ACA33539
augaaccccuaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuucuacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77398 - RNA, 1413 nt, Artificial Sequence
  derived and/or modified sequence opt1 from neuraminidase__InfluenzaA__ACA33540
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuucuacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77399 - RNA, 1413 nt, Artificial Sequence
  derived and/or modified sequence opt1 from neuraminidase__InfluenzaA__ACA33582
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuucuacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccgaugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcagcuccaucagcuucugcggggucgacuccgacaccgccaacuggagcuggcccgacggcgccgagcugcccuucaccaucgacaaguga

SEQ ID NO: 77400 - RNA, 1413 nt, Artificial Sequence
  derived and/or modified sequence opt1 from neuraminidase__InfluenzaA__ACA33622
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuucuacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77401 - RNA, 1413 nt, Artificial Sequence; identical to SEQ ID NO: 77077
  derived and/or modified sequence opt1 from neuraminidase__InfluenzaA__ACA96522

SEQ ID NO: 77402 - RNA, 1362 nt, Artificial Sequence
  derived and/or modified sequence opt1 from neuraminidase__InfluenzaA__ACC55274
augaaccccaaccagaagaucaucaccaucggcagcgugucccugaccaucgccacggucugcuuccucaugcagaucgccauccuggcgaugaccgugacccugcacuuccgccagaacgagugcagcaucuccgccaacagccagguggucccgugcgagcccaccacggagaaggaggugugcuccaagguggucgacuaccggagcugguccaagccccagugccagaucaccggguucgcccccuucagcaaggacaacuccauccgccucagcgccggcggggacaucuggaucacccgggagccguacguguccugcgacaccagcaagugcuaccaguucgcccugggccaggggacgacccuggacaacgagcacuccaacggcaccauccacgaccgcaucccccaccggacccuccugaugaacgagcugggcgugcccuuccaccucgggacgcgccaggucugcaucgcguggagcuccagcuccugccacgacggcaaggccuggcugcacgugugcgugaccggggacgaccggaacgccaccgccagcuucaucuacaacggcaugcuggucgacuccaucgggagcuggagccagaacauccuccgcacccaggaguccgagugcgugugcaucaacggcagcugcacgguggucaugaccgacggcuccgcgagcgggaaggccgacacccggauccuguucgugaaggagggcaagaucgugcacaucagcccccuguccggguccgcccagcacaucgaggagugcagcugcuacccgcgcuaccccaacguccggugcgugugccgcgacaacuggaagggcuccaaccggcccgugaucgacaucaacaugaccgacuacagcaucgacuccagcuacgucugcuccggccucgugggggacacgccccgcaacgaggacagcuccagcuccagcaacugccgggacccgaacgaggagcgcggcaaccccggggugaagggcugggccuucgacuccggggacgacgucuggaugggccggaccaucagccgcgacagccgguccggcuacgagaccuuccgcgugaucgggggcuggaccacggccaacagcaagucccagaccaaccggcaggucaucguggacaacaacaacuggagcggguacuccggcaucuucagcguggagcacaaguccugcaucaaccgcugcuucuacgucgagcugauccgcgggcggcccaaggagacccgcgugugguggaccagcaacuccaucguggucuucugcggcacgagcggcaccuacgggaccggcuccuggcccgacggggcgaacaucaacuucaugccgaucuga

SEQ ID NO: 77403 - RNA, 1413 nt, Artificial Sequence; identical to SEQ ID NO: 77337
  derived and/or modified sequence opt1 from neuraminidase__InfluenzaA__ACC61967

SEQ ID NO: 77404 - RNA, 1413 nt, Artificial Sequence
  derived and/or modified sequence opt1 from neuraminidase__InfluenzaA__ACD11077
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggugaccaccagcaugacccuggcgggcaacuccagccugugcccgauccggggcugggccaucuacuccaaggacaacagcauccgcaucggguccaagggcgacguguucgucauccgggagcccuucaucagcugcucccaccucgagugccgcacguucuuccugacccagggggcccugcucaacgacaagcacagcaacggcaccgugaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccgucgcggugcucaaguacaacggcaucaucacggagaccaucaagagcuggcgcaagcagauccugcggacccaggaguccgagugcgugugcgucaacggcagcugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgugaugugcgugugccgggacaacuggcacgggagcaaccgccccugggucuccuucaaccagaaccucgacuaccagaucggcuacaucugcagcggcguguucggggacaacccgcggcccaaggacggcaagggguccugcgaccccgugaacgucgacggcgccgacggggugaagggcuucagcuaccgcuacggcaacgggguguggaucggccggacgaaguccaacaacagccgcaagggguucgagaugaucugggaccccaacggcuggaccgacaccgacuccaacuuccuggucaagcaggacgugguggccaugaccgacuggagcggguacagcggcuccuucguccagcacccggagcugacgggccucgacugcaugcggcccugcuucuggguggagcugauccgcgggcggccccgcgagaagaccaccaucuggaccagcggcuccagcaucuccuucugcggggucaacagcgacacggugaacugguccuggcccgacggcgcggagcugccgcucaccaucgacaaguga

SEQ ID NO: 77405 - RNA, 1413 nt, Artificial Sequence
  derived and/or modified sequence opt1 from neuraminidase__InfluenzaA__ACD11078
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcagcugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggagcaaccgccccuggguguccuucaaccagaaccucgacuaccagaucggcuacaucugcagcggcgucuucggggacaacccgcggcccaaggacggcaagggguccugcgaccccgugaacguggacggcgccgacggggucaagggcuucagcuaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggagcggguacuccggcagcuucgugcagcacccggagcugacgggccucgacugcaugcggcccugcuucugggucgagcugauccgcgggcggccccgcgagaagaccaccaucuggaccuccggcagcuccaucagcuucugcggggugaacuccgacacggucaacuggagcuggcccgacggcgcggagcugccgcucaccaucgacaaguga

SEQ ID NO: 77406 - RNA, 1413 nt, Artificial Sequence
  derived and/or modified sequence opt1 from neuraminidase__InfluenzaA__ACD11079
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccagccugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugccccaucggggaggccccgucccccuacaacagccgguucgagagcguggcgugguccgccagcgccugccacgacggcaugggcuggcugaccaucgggaucuccggccccgacgacggggccguggcggucaucaaguacaacggcaucaucacggagaccaucaagagcuggcgcaagcagauccuccggacccaggaguccgagugcgugugcgugaacggcagcugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggagcaaccgccccuggguguccuucaaccagaaccuggacuaccagaucggcuacaucugcagcggcgucuucggggacaacccgcggcccaaggacggcaagggguccugcgaccccgugaacguggacggcgccgacggggucaagggcuucagcuaccgcuacggcaacgggguguggaucggccggacgaaguccaacagcucccgcaagggguucgagaugaucugggaccccaacggcuggaccgacaccgacagcaacuuccucgugaagcaggacgucguggccaugaccgacuggagcggguacuccggcagcuucgugcagcacccggagcugacgggccuggacugcaugcggcccugcuucugggucgagcucauccgcgggcggccccgcgagaagaccaccaucuggaccuccggcagcuccaucagcuucugcggggugaacuccgacacggucaacuggagcuggcccgacggcgcggagcugccgcugaccaucgacaaguga

SEQ ID NO: 77407 - RNA, 1413 nt, Artificial Sequence; identical to SEQ ID NO: 77038
  derived and/or modified sequence opt1 from neuraminidase__InfluenzaA__ACD56116

SEQ ID NO: 77408 - RNA, 1413 nt, Artificial Sequence; identical to SEQ ID NO: 77038
  derived and/or modified sequence opt1 from neuraminidase__InfluenzaA__ACD56127

SEQ ID NO: 77409 - RNA, 1410 nt, Artificial Sequence; identical to SEQ ID NO: 76892
  derived and/or modified sequence opt1 from neuraminidase__InfluenzaA__ACD56261

SEQ ID NO: 77410 - RNA, 1410 nt, Artificial Sequence
  derived and/or modified sequence opt1 from neuraminidase__InfluenzaA__ACD56272
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 77411 - RNA, 1413 nt, Artificial Sequence
  derived and/or modified sequence opt1 from neuraminidase__InfluenzaA__ACD56283
augaaccccaaccagaagaucaucaccaucggcagcaucuccauggccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 77412 - RNA, 1410 nt, Artificial Sequence
  derived and/or modified sequence opt1 from neuraminidase__InfluenzaA__ACD56305
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggcguggcugcacgucugcgugaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgccagcgggcgggcggacacgcgcauccuguucaucgaggagggcaagaucguccacaucagcccccucuccgggagcgcccagcacguggaggagugcuccugcuacccccgguacccggacgugcgcugcaucugccgggacaacuggaagggcagcaaccgccccgucaucgacaucaacauggaggacuacuccaucgacagcuccuacgugugcagcggccuggugggggacacgccccggaacgacgaccgcuccagcaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucguggacuccaacaacuggagcggguacuccggcaucuucagcgucgagggcaagagcugcaucaaccggugcuucuacguggagcucauccgcggccggcagcaggagacccgcgugugguggaccuccaacagcaucgucguguucugcggcaccuccgggacguacggcaccgggagcuggcccgacggcgccaacaucaacuucaugcccaucuga

SEQ ID NO: 77413 - RNA, 1410 nt, Artificial Sequence
  derived and/or modified sequence opt1 from neuraminidase__InfluenzaA__ACD56316
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggcguggcugcacgucugcgugaccggggacgacaagaacgccaccgccagcuucaucuacgacggccggcucauggacuccaucgggagcuggucccagaacauccugcgcacgcaggagagcgagugcgugugcaucaacgggaccugcaccgucgugaugaccgacggcuccgccagcggccgggcggacacgcgcauccuguucaucgaggagggcaagaucgugcacaucagcccccucuccgggagcgcccagcacgucgaggagugcuccugcuacccccgguacccggacgugcgcugcaucugccgggacaacuggaagggcagcaaccgccccgugaucgacaucaacauggaggacuacuccaucgacagcuccuacgucugcagcggccuggugggggacacgccccggaacgacgaccgcuccagcaacuccaacugccggaaccccaacaacgagcgcggcaacccgggggugaagggcugggccuucgacaacggggacgacgucuggaugggccggaccaucagcaaggaccugcgcuccggcuacgagaccuucaaggugaucgggggcuggagcacccccaacuccaagagccagaucaaccggcaggucaucguggacuccaacaacuggagcggguacuccggcaucuucagcguggaggggaagcgcugcaucaaccgcugcuucuacgucgagcucauccggggccgccagcaggagacccgggugugguggaccagcaacuccaucguggucuucugcggcaccagcgggacguacggcaccggguccuggcccgacggcgccaacaucaacuucaugcccaucuga

SEQ ID NO: 77414 - RNA, 1410 nt, Artificial Sequence
  derived and/or modified sequence opt1 from neuraminidase__InfluenzaA__ACD56327
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccuccaagugccaccaguucgcccugggccaggggaccacccucgagaacaagcacagcaacggcaccaagcacgaccgcaucccgcaccggacgcugcugaugaacgagcucggcgugcccuuccaccuggggaccaagcaggucugcguggcgugguccagcuccagcugccacgacggcaaggccuggcugcacgugugcgucaccggggacgaccgcaacgccaccgccuccuucaucuacggcgggcggcucguggacagcaucguguccuggagccagaacauccugcgcacgcaggaguccgagugcgucugcaucaacgggaccugcaccguggugaugaccgacggcagcgcgagcggccgggccgacacgcgcauccuguucaucaaggagggcaagaucguccacaucagcccccucuccggguccgcccagcacaucgaggagugcagcugcuacccccgguacccggacgugcgcugcaucugccgggacaacuggaagggcuccaaccgccccgugaucgacaucaacauggaggacuacagcaucgacuccagcuacgucugcuccggccuggugggggacacgccccggaacgacgacagcuccagcaacuccaacugccgcgaccccaacaacgagcggggcaacccgggggugaagggcugggccuucgacaacggggacgacgucuggaugggccgcaccaucagcaaggacucccggagcggcuacgagaccuucaaggugaucgggggcugguccacccccaacagcaagucccaggucaaccgccaggugaucguggacagcaacaacuggagcggguacuccggcaucuucagcgucgaggggaaguccugcaucaaccggugcuucuacguggagcugauccgcggccgcccccaggagacccgggugugguggaccagcaacuccaucgucguguucugcggcaccagcgggacguacggcaccggguccuggcccgacggcgccaacaucaacuucaugccgaucuga

SEQ ID NO: 77415 - RNA, 1410 nt, Artificial Sequence
  derived and/or modified sequence opt1 from neuraminidase__InfluenzaA__ACD85190
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcgucaccggggacgacaagaacgccaccgccagcuucaucuacgacggccggcucguggacuccaucgggagcuggucccagaacauccugcgcacgcaggagagcgagugcgugugcaucaacgggaccugcaccgucgugaugaccgacggcuccgccagcgggcgggcggacacgcgcauccuguucaucgaggagggcaagaucgugcacaucagcccccucuccgggagcgcccagcacgucgaggagugcuccugcuacccccgguacccggacgugcgcugcaucugccgggacaacuggaagggcagcaaccgccccaucaucgacaucaacauggaggacuacuccaucgacagcuccuacgugugcagcggccuggucggggacacgccccggaacgacgaccgcuccagcaacuccaacugccggaaccccaacaacgagcgcggcaacccgggggugaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucgucgacuccaacaacuggagcggguacuccggcaucuucagcguggagggcaagagcugcaucaaccggugcuucuacguggagcucauccgcggccggcagcaggagacccgcgucugguggaccuccaacagcaucgugguguucugcggcaccuccgggacguacggcaccgggagcuggcccgacggcgccaacaucaacuucaugcccaucuga

SEQ ID NO: 77416 - RNA, 1410 nt, Artificial Sequence
  derived and/or modified sequence opt1 from neuraminidase__InfluenzaA__ACD85201
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcgucaccggggacgacaagaacgccaccgccagcuucaucuacgacggccggcucguggacuccaucagcuccuggagccagaacauccugcgcacgcaggaguccgagugcgugugcaucaacgggaccugcaccgucgugaugaccgacggcagcgccagcggccgggcggacacgcgcauccuguucaucgaggaggggaagaucgugcacaucagcccccucuccggcuccgcccagcacgucgaggagugcagcugcuacccccgguacccggacgugcgcugcaucugccgggacaacuggaagggguccaaccgccccgugaucgacaucaacauggaggacuacagcaucgacuccagcuacgucugcuccggccuggugggcgacacgccccggaacgacgaccgcagcuccaacagcaacugccggaaccccaacaacgagcgcgggaacccgggcgugaaggggugggccuucgacaacggcgacgacgucuggauggggcggaccaucuccaaggaccugcgcagcggcuacgagaccuucaaggugaucggcgggugguccacccccaacagcaagucccagaucaaccggcaggucaucguggacagcaacaacugguccggcuacagcgggaucuucagcguggagggcaaguccugcaucaaccgcugcuucuacgucgagcucauccgcgggcggcagcaggagacccgcgugugguggaccagcaacuccaucguggucuucugcggcaccagcggcacguacgggaccggcuccuggcccgacggggccaacaucaacuucaugcccaucuga

SEQ ID NO: 77417 - RNA, 1410 nt, Artificial Sequence
  derived and/or modified sequence opt1 from neuraminidase__InfluenzaA__ACD85212
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucaaggagaucgucuaccucaacaacacgaccaucgagaaggagaucugccccgaggugguggaguaccggaacuggagcaagccgcagugccagaucaccggguucgcccccuucuccaaggacaacagcauccgccuguccgccggcggggacaucugggucacccgggagcccuacgugagcugcgaccccggcaagugcuaccaguucgcccuggggcagggcacgacccucgacaacaagcacuccaacggcaccauccacgaccgcaucccgcaccggacccugcugaugaacgagcucggggugcccuuccaccugggcacgaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacccaggagagcgagugcgugugcaucaacggcacgugcaccgucgugaugaccgacggguccgcgagcggccgggccgacacccgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacgcgggugugguggaccuccaacagcaucguggucuucugcgggaccuccggcaccuacgggacgggcagcuggcccgacggggccaacaucaacuucaugccgaucuga

SEQ ID NO: 77418 - RNA, 1410 nt, Artificial Sequence
  derived and/or modified sequence opt1 from neuraminidase__InfluenzaA__ACD85223
augaaccccaaccagaagaucaucaccaucggcagcgugucccugaccaucgccacggccugcuuccucaugcagaucgcgauccuggucaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccaaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgcguggagcuccagcuccugccacgacggcaaggccuggcugcacgugugcgugaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgcgagcgggcgggccgacacgcgcauccuguucaucgaggagggcaagaucgugcacaucagcccccucuccgggagcgcccagcacguggaggagugcuccugcuacccccgguacccggacguccgcugcaucugccgggacaacuggaagggcagcaaccgccccaucaucgacaucaacauggaggacuacuccaucgacagcuccuacgugugcagcggccuggugggggacacgccccggaacgacgaccgcuccagcaacuccaacugccggaaccccaacaacgagcgcggcaacccgggggucaagggcugggccuucgacaacggggacgacguguggaugggccggaccaucagcaaggaccugcgcuccggcuacgagaccuucaaggugaucgggggcuggagcacccccaacuccaagagccagaucaaccggcaggucaucguggacuccaacaacuggagcggguacuccggcaucuucagcgucgagggcaagagcugcaucaaccgcugcuucuacguggagcucauccgcggccggcagcaggagacccgcgugugguggaccuccaacagcaucgucguguucugcggcaccuccgggacguacggcaccgggagcuggcccgacggcgccaacaucaacuucaugcccaucuga

SEQ ID NO: 77419 - RNA, 1410 nt, Artificial Sequence
  derived and/or modified sequence opt1 from neuraminidase__InfluenzaA__ACD85234
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccgacggcgacaucugggucacgcgggagcccuacgugagcugcgaccccgggaagugcuaccaguucgcccugggccaggggaccacccucgacaacaagcacuccaacggcaccauccacgaccgcaucccgcaccggacgcugcugaugaacgagcucggcgugcccuuccaccuggggaccaagcaggucugcguggcguggagcuccagcuccugccacgacggcaaggccuggcugcacgugugcgucaccggggacgaccgcaacgccaccgccagcuucaucuacgacggccggcucguggacuccaucgggagcuggucccagaacauccugcgcacgcaggagagcgagugcgugugcaucaacgggaccugcaccgucgugaugaccgacggcuccgcgagcgggcgggccgacacgcgcauccuguucaucaaggagggcaagaucgugcacaucagcccccucuccgggagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcggccuggucggggacacgccccggaacgacgacuccagcuccaacagcaacugccgcgaccccaacaacgagcggggcaacccgggggugaagggcugggccuucgacaacggggacgacguguggaugggccgcaccaucuccaaggaccugcggagcggcuacgagaccuucaaggucaucgggggcugguccacccccaacagcaagucccaggugaaccgccaggucaucguggacaacaacaacuggagcggguacuccggcaucuucagcguggagggcaagagcugcaucaaccggugcuucuacgucgagcucauccgcggccgcccccaggagacccgggugugguggaccuccaacagcaucguggucuucugcggcaccuccgggacguacggcaccgggagcuggcccgacggcgccaacaucaacuucaugccgaucuga

SEQ ID NO: 77420 - RNA, 1410 nt, Artificial Sequence
  derived and/or modified sequence opt1 from neuraminidase__InfluenzaA__ACD85245
augaaccccaaccagaagaucaucaccaucggcagcgugucccugaucaucgccaccgucugcuuccucaugcagaucgccauccuggugacgaccgugacccugcacuucaagcagcacgagugcgacagcccggcguccaaccaggucaugcccugcgagcccaucaucaucgagcgcaacaucaccgagaucguguaccucaacaacacgaccaucgagaaggagaucugcccccggguggucgaguaccgcaacuggagcaagccgcagugccagaucaccggguucgcccccuucuccaaggacaacagcauccggcuguccgccggcggggacaucugggugacccgcgagcccuacgugagcugcgaccccggcaagugcuaccaguucgcccuggggcagggcacgacccucgacaacaagcacuccaacgacaccauccacgaccggaucccgcaccgcacccugcugaugaacgagcucggcguccccuuccaccuggggacgcgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcggacccaggagagcgagugcgugugcaucaacggcacgugcaccguggucaugaccgacggcuccgccagcgggcgcgcggacacccggauccuguucaucgaggagggcaagaucgugcacaucagcccccucuccgggagcgcccagcacguggaggagugcuccugcuacccccgcuacccgggcguccggugcaucugccgcgacaacuggaagggcagcaaccggcccgugguggacaucaacauggaggacuacuccaucgacagcuccuacgucugcagcgggcuggugggcgacacgccccgcaacgacgaccgguccagcaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggagcaccccgaacuccaagagccagaucaaccgccaggucaucguggacuccgacgaccgcagcggcuacuccgggaucuucagcguggagggcaagagcugcaucaaccggugcuucuacgucgagcucauccgcggccggaagcaggagacgcgcgugugguggaccuccaacagcaucguggucuucugcgggaccuccggcaccuacgggacgggcagcuggcccgacggggccaacaucaacuucaugcccaucuga

SEQ ID NO: 77421 - RNA, 1410 nt, Artificial Sequence
  derived and/or modified sequence opt1 from neuraminidase__InfluenzaA__ACD85454
augaaccccaaccagaagaucaucaccaucggcagcgugucccugaccaucagcacgaucggguucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacagcauccgccuguccgccgggggcgacaucugggucacccgggagcccuacgugagcugcgaccccgacaagugcuaccaguucgcccucgggcagggcacgacccugaacaacgugcacuccaacgacaccguccgcaaccggaccccguaccgcacgcugcucaugaacgagcugggcgugcccuuccaccuggggaccaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacgcaggagagcgagugcgucugcaucaacgggaccugcaccguggugaugaccgacggcuccgccagcggcaaggccgacacgaagauccucuucaucgaggaggggaagaucguccacaccagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggacguccggcaccuacgggaccggcagcuggccggacggggccgacaucaaccugaugcccaucuga

SEQ ID NO: 77422 - RNA, 1410 nt, Artificial Sequence
  derived and/or modified sequence opt1 from neuraminidase__InfluenzaA__ACD85465
augaaccccaaccagaagaucaucaccaucggcagcgugucccugaccaucagcacgaucggguucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacagcauccgccuguccgccgggggcgacaucugggucacccgggagcccuacgugagcugcgaccccgacaagugcuaccaguucgcccucgggcagggcacgacccugaacaacgugcacuccaacgacaccguccgcgaccggaccccguaccgcacgcugcucaugaacgagcugggcgugcccuuccaccuggggaccaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacgcaggagagcgagugcgucugcaucaacgggaccugcaccguggugaugaccgacggcuccgccagcggcaaggccgacacgaagauccucuucaucgaggaggggaagaucguccacaccagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggacguccggcaccuacgggaccggcagcuggccggacggggccgacaucaaccugaugcccaucuga

SEQ ID NO: 77423 - RNA, 1410 nt, Artificial Sequence
  derived and/or modified sequence opt1 from neuraminidase__InfluenzaA__ACD85487
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77424 - RNA, 1410 nt, Artificial Sequence
  derived and/or modified sequence opt1 from neuraminidase__InfluenzaA__ACD85498
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77425 - RNA, 1410 nt, Artificial Sequence
  derived and/or modified sequence opt1 from neuraminidase__InfluenzaA__ACD85509
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcaaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggcuccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggaggggagccgcggcgugaaggggugggccuucgacgacggcaacgacgucuggauggggcggaccaucuccgagaagucccgccugggcuacgagaccuucaaggugaucgagggcuggagcaaccccaagagcaagcugcagaucaaccggcaggucaucguggaccgcgggaaccgguccggcuacagcgggaucuucagcguggagggcaaguccugcaucaaccgcugcuucuacgucgagcucauccgggggcgcaaggaggagaccgaggugcuguggaccagcaacuccaucguggucuucugcggcacgagcggcaccuacgggaccggcuccuggccggacggggccgacaucaaccugaugcccaucuga

SEQ ID NO: 77426 - RNA, 1410 nt, Artificial Sequence
  derived and/or modified sequence opt1 from neuraminidase__InfluenzaA__ACD85520
augaaccccaaccagaagaucaucaccaucggcagcgugucccugaucaucagcaccaucggguucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacgacaccguccgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 77427 - RNA, 1410 nt, Artificial Sequence; identical to SEQ ID NO: 77422
  derived and/or modified sequence opt1 from neuraminidase__InfluenzaA__ACD85553

SEQ ID NO: 77428 - RNA, 1410 nt, Artificial Sequence
  derived and/or modified sequence opt1 from neuraminidase__InfluenzaA__ACD85564
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaccgcccaccucaccaacacgaccaucgagaaggagaucugccccaagcuggcggaguaccggaacuggagcaagccgcagugcgacaucaccggguucgcccccuucuccaaggacaacagcauccgccuguccgccggcggggacaucugggugacccgggagcccuacgucagcugcgaccccgacaagugcuaccaguucgcccucggccaggggacgacccugaacaacgugcacuccaacgacaccgugcgcgaccggaccccguaccgcacgcugcucaugaacgagcugggcguccccuuccaccugggcaccaagcaggucugcaucgccuggagcuccagcuccugccacgacgggaaggcguggcuccacgugugcaucaccggcgacgacaagaacgccaccgccagcuucaucuacaacgggcggcugguggacuccaucgugagcugguccaaggagauccugcgcacgcaggagagcgagugcgugugcaucaacgggaccugcaccgucgugaugaccgacggguccgccagcggcaaggcggacacgaagauccucuucaucgaggagggcaagaucgugcacaccagcacccuguccgggagcgcccagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcggccacggggugaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcacguccgggaccuacggcaccgggagcuggccggacggcgccgacaucaaccugaugcccaucuga

SEQ ID NO: 77429 - RNA, 1410 nt, Artificial Sequence
  derived and/or modified sequence opt1 from neuraminidase__InfluenzaA__ACD85575
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccacaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgacaucaaccugaugccgaucuga

SEQ ID NO: 77430 - RNA, 1410 nt, Artificial Sequence
  derived and/or modified sequence opt1 from neuraminidase__InfluenzaA__ACD85586
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccgcggggugaagggcugggccuucgacgacgggaacgacgucuggaugggccggaccaucagcgagaagucccgccugggcuacgagaccuucaaggugaucgagggguggagcaaccccaaguccaagcugcagaccaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggacguccaacagcaucguggucuucugcggcaccuccgggaccuacggcaccgggagcuggccggacggcgccgacaucaaccugaugcccaucuga

SEQ ID NO: 77431 - RNA, 1410 nt, Artificial Sequence
  derived and/or modified sequence opt1 from neuraminidase__InfluenzaA__ACD93582
augaaccccaaccagaagaucaucaccaucggcagcgugucccugaccaucagcacgaucugcuucuucaugcagaucgccauccucgccaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccagcuccugccacgacggcaaggcguggcuccacgugugcaucaccggggacgacaagaacgccaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggcggacaccaagauccucuucaucgaggaggggaagaucguccacacgagcacccuguccggcagcgcccagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggacaaggggaaccggagcggcuacuccgggaucuucagcguggagggcaagagcugcaucaaccgcugcuucuacgucgagcucauccggggccgcaaggaggagaccgaggugcuguggaccuccaacagcaucguggucuucugcgggaccuccggcacguacgggaccggcagcuggccggacggggccgacaucaaccugaugcccaucuga

SEQ ID NO: 77432 - RNA, 1410 nt, Artificial Sequence; identical to SEQ ID NO: 75720
  derived and/or modified sequence opt1 from neuraminidase__InfluenzaA__ACF09403

SEQ ID NO: 77433 - RNA, 1410 nt, Artificial Sequence; identical to SEQ ID NO: 76937
  derived and/or modified sequence opt1 from neuraminidase__InfluenzaA__ACF22151

SEQ ID NO: 77434 - RNA, 1410 nt, Artificial Sequence; identical to SEQ ID NO: 75103
  derived and/or modified sequence opt1 from neuraminidase__InfluenzaA__ACF22246

SEQ ID NO: 77435 - RNA, 1410 nt, Artificial Sequence; identical to SEQ ID NO: 75103
  derived and/or modified sequence opt1 from neuraminidase__InfluenzaA__ACF22257

SEQ ID NO: 77436 - RNA, 1410 nt, Artificial Sequence; identical to SEQ ID NO: 75103
  derived and/or modified sequence opt1 from neuraminidase__InfluenzaA__ACF22279

SEQ ID NO: 77437 - RNA, 1410 nt, Artificial Sequence; identical to SEQ ID NO: 75103
  derived and/or modified sequence opt1 from neuraminidase__InfluenzaA__ACF22290

SEQ ID NO: 77438 - RNA, 1410 nt, Artificial Sequence; identical to SEQ ID NO: 75103
  derived and/or modified sequence opt1 from neuraminidase__InfluenzaA__ACF22301

SEQ ID NO: 77439 - RNA, 1410 nt, Artificial Sequence; identical to SEQ ID NO: 75103
  derived and/or modified sequence opt1 from neuraminidase__InfluenzaA__ACF22312

SEQ ID NO: 77440 - RNA, 1410 nt, Artificial Sequence
  derived and/or modified sequence opt1 from neuraminidase__InfluenzaA__ACF22323
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccuacgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 77441 - RNA, 1410 nt, Artificial Sequence; identical to SEQ ID NO: 75103
  derived and/or modified sequence opt1 from neuraminidase__InfluenzaA__ACF22334

SEQ ID NO: 77442 - RNA, 1410 nt, Artificial Sequence; identical to SEQ ID NO: 75103
  derived and/or modified sequence opt1 from neuraminidase__InfluenzaA__ACF22367

SEQ ID NO: 77443 - RNA, 1410 nt, Artificial Sequence
  derived and/or modified sequence opt1 from neuraminidase__InfluenzaA__ACF22378
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugcaagaaccccaacaacgagcgggggaaccagggcgugaaggggugggccuucgacaacggcgacgacgucuggaugggccgcaccaucagcaaggaccugcgguccggguacgagaccuucaaggugaucggcggguggagcacccccaacuccaagagccagaucaaccgccaggucaucguggacuccgacaaccggagcggcuacuccgggaucuucagcguggagggcaagagcugcaucaaccgcugcuucuacgucgagcucauccgcggccggaagcaggagacccgcgugugguggaccuccaacagcaucguggucuucugcgggaccuccggcacguacgggaccggcagcuggccggacggggccaacaucaacuucaugcccaucuga

SEQ ID NO: 77444 - RNA, 1410 nt, Artificial Sequence
  derived and/or modified sequence opt1 from neuraminidase__InfluenzaA__ACF22389
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgugcccuucuccaaggacaacagcauccgccuguccgccggcggggacaucugggugacgcgggagcccuacgucagcugcgaccacggcaagugcuaccaguucgcccuggggcagggcaccacccucgacaacaagcacuccaacgacaccauccacgaccgcaucccccaccggacgcugcugaugaacgagcucggcgugccguuccaccuggggacccgccaggugugcaucgccuggagcuccagcuccugccacgacggcaaggccuggcugcacgucugcaucaccggggacgacaagaacgcgaccgccagcuucaucuacgacggccggcucguggacuccaucgggagcuggucccagaacauccugcgcacgcaggagagcgagugcgugugcaucaacgggaccugcaccgucgugaugaccgacggcuccgccagcggccgggccgacacgcgcauccuguucaucgaggagggcaagaucgugcacaucagcccccucuccgggagcgcgcagcacgucgaggagugcuccugcuacccccgguaccccggcgugcgcugcaucugccgggacaacuggaagggcagcaaccgcccgguggucgacaucaacauggaggacuacuccaucgacagcuccuacgugugcagcgggcuggugggcgacacgccccggaacgacgaccgcuccagcaacuccaacugccggaaccccaacaacgagcgcgggaaccagggcgucaaggggugggccuucgacaacggcgacgacguguggaugggccggaccaucagcaaggaccugcgcuccggguacgagaccuucaaggucaucggcggguggagcacccccaacuccaagagccagaucaaccgccaggugaucguggacuccgacaaccggagcggcuacuccgggaucuucagcgucgagggcaagagcugcaucaaccgcugcuucuacguggagcucauccggggccgcaagcaggagacccgggugugguggaccuccaacagcaucgucguguucugcgggaccuccggcacguacgggaccggcagcuggccggacggggccaacaucaacuucaugcccaucuga

SEQ ID NO: 77445 - RNA, 1410 nt, Artificial Sequence
  derived and/or modified sequence opt1 from neuraminidase__InfluenzaA__ACF22400
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucauggacuccaucgggagcuggucccagaacauccugcgcacgcaggagagcgagugcgucugcaucaacgggaccugcaccguggugaugaccgacggcuccgccagcggccgggcggacacgcgcauccuguucaucgaggagggcaagaucguccacaucagcccccucuccgggagcgcccagcacguggaggagugcuccugcuacccccgguaccccggcgugcgcugcaucugccgggacaacuggaagggcagcaaccgcccggucguggacaucaacauggaggacuacuccaucgacagcuccuacgugugcagcgggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggagcacccccaacuccaagagccagaucaaccgccaggugaucgucgacuccgacaaccggagcggcuacuccgggaucuucagcguggagggcaagagcugcaucaaccgcugcuucuacguggagcucauccggggccgcaagcaggagacccgggucugguggaccuccaacagcaucgugguguucugcgggaccuccggcacguacgggaccggcagcuggccggacggggccaacaucaacuucaugcccaucuga

SEQ ID NO: 77446 - RNA, 1410 nt, Artificial Sequence; identical to SEQ ID NO: 77074
  derived and/or modified sequence opt1 from neuraminidase__InfluenzaA__ACF22411

SEQ ID NO: 77447 - RNA, 1413 nt, Artificial Sequence
  derived and/or modified sequence opt1 from neuraminidase__InfluenzaA__ACF33772
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccaucuacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggugaccaaguccauggagcucaacgccccgaacuucuacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccgaaggacggggagggcagcugcaaccccgugacgguggacggggcgaacggcgucaagggcuucuccuacaaguacgggaacggcguguggaucgggcggaccaagagcaaccgcauccggaagggcuucgagaugaucugggaccccaacggguggaccaacaccgacuccgacuucagcgugaagcaggacaucgucgccaucacggacugguccggcuacagcggcagcuucgugcagcaccccgagcugaccgggcucgacugcauccgcccgugcuucuggguggagcugguccggggccugccccgcgagaacaccaccaucuggacguccgggagcuccaucagcuucugcggcgugaacuccgacaucgccaacuggagcuggcccgacggcgccgagcuccccuucaccaucgacaaguga

SEQ ID NO: 77448 - RNA, 1410 nt, Artificial Sequence
  derived and/or modified sequence opt1 from neuraminidase__InfluenzaA__ACF33778
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcauccccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucguguccuggagcaaggagauccugcggacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagaacguggaggagugcagcugcuacccccgcuaccccggcgugcggugcgucugccgcgacaacuggaagggguccaaccggccgaucguggacaucaacaucaaggacuacagcaucgugucccgcuacgucugcagcggccuggugggcgacacgccccggaagaacgacuccagcuccagcucccacugccucaaccccaacaacgaggagggcgggcacggggugaagggcugggccuucgacgacgggaacgacgucuggaugggccgcaccaucagcgagaagucccggagcggcuacgagaccuucaaggugaucgaggggugguccaaccccaacagcaagcugcagaucaaccgccaggucaucguggaccggggcaaccgcuccggguacagcggcaucuucagcguggaggggaaguccugcaucaaccggugcuucuacgucgagcugauccgcggccggaaggaggagaccgaggugcucuggaccagcaacuccaucguggucuucugcggcaccagcgggacguacggcaccggguccuggccggacggcgccgacaucaaccugaugcccaucuga

SEQ ID NO: 77449 - RNA, 1410 nt, Artificial Sequence
  derived and/or modified sequence opt1 from neuraminidase__InfluenzaA__ACF33785
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgugcgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 77450 - RNA, 1413 nt, Artificial Sequence
  derived and/or modified sequence opt1 from neuraminidase__InfluenzaA__ACF33787
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccaucuacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccgggaacggcgccgccuccuacaagaucuucaagaucgagaaggggaaggugaccaagagcauggagcucaacgccccgaacuuccacuacgaggagugcuccugcuaccccgacaccggcaccgucaugugcgugugccgcgacaacuggcacggcagcaaccggcccuggguguccuucaaccagaaccuggacuaccagaucggguacaucugcagcggcgucuucggggacaacccccgcccgaaggacggcgagggguccugcaaccccgugacgguggacggcgcgaacggcgucaagggguucagcuacaaguacggcaacgggguguggaucggccggaccaaguccaaccgcauccggaagggguucgagaugaucugggaccccaacggcuggaccaacaccgacagcgacuucuccgugaagcaggacaucgucgccaucacggacuggagcggcuacuccgggagcuucgugcagcaccccgagcugaccggccucgacugcauccgcccgugcuucuggguggagcugguccgggggcugcccaaggagaacaccaccaucuggacgagcggcuccagcaucuccuucugcggcgugaacagcgggaucgccaacugguccuggcccgacggcgccgagcuccccuucaccaucgacaaguga

SEQ ID NO: 77451 - RNA, 1410 nt, Artificial Sequence; identical to SEQ ID NO: 76892
  derived and/or modified sequence opt1 from neuraminidase__InfluenzaA__ACF33798

SEQ ID NO: 77452 - RNA, 1410 nt, Artificial Sequence; identical to SEQ ID NO: 77065
  derived and/or modified sequence opt1 from neuraminidase__InfluenzaA__ACF41672

SEQ ID NO: 77453 - RNA, 1413 nt, Artificial Sequence; identical to SEQ ID NO: 77038
  derived and/or modified sequence opt1 from neuraminidase__InfluenzaA__ACF41683

SEQ ID NO: 77454 - RNA, 1410 nt, Artificial Sequence
  derived and/or modified sequence opt1 from neuraminidase__InfluenzaA__ACF41749
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggggaucguguaccucaacaacaccaccaucgagaaggagaucugccccaagguggucgaguaccggaacuggagcaagccgcagugccagaucaccggcuucgcccccuucuccaaggacaacagcauccgccuguccgccgggggcgacaucugggugacgcgggagcccuacgugagcugcgaccacgggaagugcuaccaguucgcccugggccagggcaccacccucgacaacaagcacuccaacgacaccauccacgaccgcaucccccaccggacgcugcugaugaacgagcucggggucccguuccaccugggcacccgccaggugugcaucgccuggagcuccagcuccugccacgacgggaaggcguggcugcacgugugcaucaccggcgacgacaagaacgccaccgccagcuucaucuacgacgggcggcucgucgacuccaucggcagcuggucccagaacauccugcgcacgcaggagagcgagugcgugugcaucaacgggaccugcaccguggucaugaccgacggcuccgccagcggccgggcggacacgcgcauccuguucaucgaggaggggaagaucgugcacaucagcccccucuccggcagcgcccagcacguggaggagugcuccugcuacccccgguaccccggcguccgcugcaucugccgggacaacuggaaggggagcaaccgcccggugguggacaucaacauggaggacuacuccaucgacagcuccuacgucugcagcggccuggugggggacacgccccggaacgacgaccgcuccagcaacuccaacugccggaaccccaacaacgagcgcggcaaccagggggugaagggcugggccuucgacaacggcgacgacgucuggauggggcggaccaucagcaaggaccugcgcuccggcuacgagaccuucaaggugaucgggggcuggagcacccccaacuccaagagccagaucaaccggcaggucaucguggacuccgacaaccgcagcggguacuccggcaucuucagcguggagggcaagagcugcaucaaccgcugcuucuacgucgagcucauccgggggcgcaagcaggagacccgggugugguggaccuccaacagcaucguggucuucugcggcaccuccgggacguacggcaccgggagcuggccggacggcgccaacaucaacuucaugcccaucuga

SEQ ID NO: 77455 - RNA, 1410 nt, Artificial Sequence
  derived and/or modified sequence opt1 from neuraminidase__InfluenzaA__ACF41760
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccgcggcaagugcuaccaguucgcccuggggcagggcaccacccucgacaacaagcacuccaacgacaccauccacgaccggaucccccaccgcacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcggacgcaggagagcgagugcgugugcaucaacgggaccugcaccguggucaugaccgacggcuccgccagcggccgcgcggacacgcggauccuguucaucgaggagggcaagaucgugcacaucagcccccucuccgggagcgcccagcacguggaggagugcuccugcuacccccgcuaccccggcguccggugcaucugccgcgacaacuggaagggcagcaaccggccggugguggacaucaacauggaggacuacuccaucgacagcuccuacgucugcagcgggcuggugggcgacacgccccgcaacgacgaccgguccagcaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggagcacccccaacuccaagagccagaucaaccgccaggucaucguggacuccgacaaccgcagcggcuacuccgggaucuucagcguggagggcaagagcugcaucaaccggugcuucuacgucgagcucauccgcggccggaagcaggagacccgcgugugguggaccuccaacagcaucguggucuucugcgggaccuccggcacguacgggaccggcagcuggccggacggggccaacaucaacuucaugcccaucuga

SEQ ID NO: 77456 - RNA, 1410 nt, Artificial Sequence
  derived and/or modified sequence opt1 from neuraminidase__InfluenzaA__ACF41771
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaucaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 77457 - RNA, 1410 nt, Artificial Sequence; identical to SEQ ID NO: 75103
  derived and/or modified sequence opt1 from neuraminidase__InfluenzaA__ACF41793

SEQ ID NO: 77458 - RNA, 1410 nt, Artificial Sequence; identical to SEQ ID NO: 75103
  derived and/or modified sequence opt1 from neuraminidase__InfluenzaA__ACF41804

SEQ ID NO: 77459 - RNA, 1410 nt, Artificial Sequence; identical to SEQ ID NO: 75103
  derived and/or modified sequence opt1 from neuraminidase__InfluenzaA__ACF41826

SEQ ID NO: 77460 - RNA, 1365 nt, Artificial Sequence; identical to SEQ ID NO: 76727
  derived and/or modified sequence opt1 from neuraminidase__InfluenzaA__ACF41837

SEQ ID NO: 77461 - RNA, 1413 nt, Artificial Sequence
  derived and/or modified sequence opt1 from neuraminidase__InfluenzaA__ACF41881
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 77462 - RNA, 1410 nt, Artificial Sequence; identical to SEQ ID NO: 76937
  derived and/or modified sequence opt1 from neuraminidase__InfluenzaA__ACF41892

SEQ ID NO: 77463 - RNA, 1410 nt, Artificial Sequence; identical to SEQ ID NO: 75335
  derived and/or modified sequence opt1 from neuraminidase__InfluenzaA__ACF41903

SEQ ID NO: 77464 - RNA, 1410 nt, Artificial Sequence
  derived and/or modified sequence opt1 from neuraminidase__InfluenzaA__ACF41914
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccugggcguccggugcgugugccgcgacaacuggaaggggagcaaccggcccaucguggacaucaacaucaaggacuacuccaucgucagcuccuacgugugcagcggccucgugggcgacaccccgcgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggcccgacggcgccgacaucaaccucaugccgaucuga

SEQ ID NO: 77465 - RNA, 1413 nt, Artificial Sequence
  derived and/or modified sequence opt1 from neuraminidase__InfluenzaA__ACF41925
augaaccccaaccagaagaucaucaccaucggcagcaucuccauggccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuaccgcaucuucaagaucgagaaggggaaggucaccaagagcaucgagcucgacgccccgaacuaccacuacgaggagugcuccugcuaccccgacaccggcaccgugaugugcgugugccgggacaacuggcacgggagcaaccgccccugggucuccuucaaccagaaccuggacuaccagaucggcuacaucugcagcggcguguucggggacaacccccggccgaaggacggcgagggguccugcaaccccgugacggucgacggcgcggacggggugaagggcuucagcuaccgcuacggcaacgggguguggaucggccggaccaaguccaaccgccugcggaagggguucgagaugaucugggaccccaacggcuggaccgacaccgacagcgacuucuccgucaagcaggacgugguggccaugacggacuggagcggguacuccggcagcuucguccagcaccccgagcucaccggccuggacugcaugcgcccgugcuucuggguggagcugauccgggggcgcccccgggagaacaccaccaucuggacgagcggcuccagcaucuccuucugcggggucaacagcgacaccgccaacugguccuggcccgacggcgccgagcuccccuucaccaucgacaaguga

SEQ ID NO: 77466 - RNA, 1413 nt, Artificial Sequence; identical to SEQ ID NO: 77465
  derived and/or modified sequence opt1 from neuraminidase__InfluenzaA__ACF41936

SEQ ID NO: 77467 - RNA, 1410 nt, Artificial Sequence
  derived and/or modified sequence opt1 from neuraminidase__InfluenzaA__ACF54392
augaaccccaaccagaagaucaucaccaucggcagcgugucccugaccacggccaccgccugcuuccucacccagaucgcgauccuggucaccacggugacccugcacuucaagcagcacgagugcgacagcccggccuccaaccaggugaugcccugcgagcccaucaucaucgagcgcaacaucaccgagaucgucuaccucaacaacaccacgaucgagaaggagaucugccccaaggugguggaguaccggaacuggagcaagccgcagugccagaucaccggguucgcccccuucuccaaggacaacagcauccgccuguccgccggcggggacaucugggucacccgggagcccuacgugagcugcgacuccggcaagugcuaccaguucgcccuggggcagggcaccacgcucgacaacaagcacagcaacgacaccauccacgaccgcaucccccaccggacccugcugaugaacgagcucggcgugccguuccaccuggggacccgccaggucugcaucgcgugguccagcuccagcugccacgacggcaaggccuggcugcacgugugcaucacgggggacgacaagaacgccaccgccuccuucaucuacgacggccggcucguggacagcaucggguccuggagccagaacauccugcgcacccaggaguccgagugcgucugcaucaacgggaccugcacgguggugaugaccgacggcagcgcgagcggccgggccgacacccgcauccuguucaucgaggagggcaagaucguccacaucagcccccucuccggguccgcccagcacguggaggagugcagcugcuacccccgguaccccggcgugcgcugcaucugccgggacaacuggaagggcuccaaccgcccggucguggacaucaacauggaggacuacagcaucgacuccagcuacgugugcuccgggcuggucggcgacacgccccggaacgacgaccgcuucagcaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggagcacccccaacuccaagagccagaucaaccgccaggugaucgucgacuccgacaaccggagcggcuacuccgggaucuucagcguggagggcaagagcugcaucaaccgcugcuucuacguggagcucauccggggccgcaagcaggagacccgggucugguggacguccaacagcaucgugguguucugcgggaccuccggcaccuacgggaccggcagcuggccggacggggccaacaucaacuucaugcccaucuga

SEQ ID NO: 77468 - RNA, 1410 nt, Artificial Sequence; identical to SEQ ID NO: 75103
  derived and/or modified sequence opt1 from neuraminidase__InfluenzaA__ACF54403

SEQ ID NO: 77469 - RNA, 1410 nt, Artificial Sequence; identical to SEQ ID NO: 75103
  derived and/or modified sequence opt1 from neuraminidase__InfluenzaA__ACF54414

SEQ ID NO: 77470 - RNA, 1410 nt, Artificial Sequence; identical to SEQ ID NO: 75103
  derived and/or modified sequence opt1 from neuraminidase__InfluenzaA__ACF54425

SEQ ID NO: 77471 - RNA, 1410 nt, Artificial Sequence; identical to SEQ ID NO: 75103
  derived and/or modified sequence opt1 from neuraminidase__InfluenzaA__ACF54436

SEQ ID NO: 77472 - RNA, 1410 nt, Artificial Sequence
  derived and/or modified sequence opt1 from neuraminidase__InfluenzaA__ACF54447
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggaccaagcaggucugcaucgccuggagcuccagcuccugccacgacggcaaggcguggcugcacgugugcaucaccggggacgacaagaacgccaccgccagcuucaucuacgacggccgccucguggacuccaucgggagcuggucccagaacauccugcggacgcaggagagcgagugcgugugcaucaacgggaccugcaccguggucaugaccgacggcuccgccagcggccgcgcggacacgcggauccuguucaucgaggagggcaagaucgugcacaucagcccccucuccgggagcgcccagcacguggaggagugcuccugcuacccccgcuaccccggcguccggugcaucugccgcgacaacuggaagggcagcaaccggccggugguggacaucaacauggaggacuacuccaucgacagcuccuacgucugcagcgggcuggugggcgacacgccccgcaacgacgaccgguccagcaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggagcacccccaacuccaagagccagaucaaccgccaggucaucguggacuccgacaaccggagcggcuacuccgggaucuucagcguggagggcaagagcugcaucaaccgcugcuucuacgucgagcucauccgcggccggaagcaggagacccgcgugugguggaccuccaacagcaucguggucuucugcgggaccuccggcacguacgggaccggcagcuggccggacggggccaacaucaacuucaugcccaucuga

SEQ ID NO: 77473 - RNA, 1410 nt, Artificial Sequence
  derived and/or modified sequence opt1 from neuraminidase__InfluenzaA__ACF54469
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcauggccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 77474 - RNA, 1410 nt, Artificial Sequence; identical to SEQ ID NO: 76768
  derived and/or modified sequence opt1 from neuraminidase__InfluenzaA__ACF54480

SEQ ID NO: 77475 - RNA, 1410 nt, Artificial Sequence
  derived and/or modified sequence opt1 from neuraminidase__InfluenzaA__ACF54502
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugagcuuccaccugggcaccaagcaggucugcguggcgugguccagcuccagcugccacgacgggaaggccuggcugcacgugugcgucaccggcgacgaccgcaacgccaccgccuccuucaucuacgacgggcggcucguggacagcaucggcuccuggagccagaacauccugcgcacgcaggaguccgagugcgugugcaucaacgggaccugcaccgucgugaugaccgacggcagcgcgagcggccgggccgacacgcgcauccuguucaucaaggaggggaagaucgugcacaucagcccccucuccggcuccgcccagcacaucgaggagugcagcugcuacccccgguaccccgacguccgcugcaucugccgggacaacuggaagggcuccaaccgcccggugaucgacaucaacauggaggacuacagcaucgacuccagcuacgugugcuccgggcuggucggcgacacgccccggaacgacgacagcuccagcaacuccaacugccgcgaccccaacaacgagcgggggaaccccggcgugaaggggugggccuucgacaacggcgacgacguguggaugggccgcaccaucaacaaggacagccgguccggguacgagaccuucaaggucaucggcggguggagcaccccgaacuccaagagccaggugaaccgccaggucaucguggacaacaacaacugguccggcuacagcgggaucuucagcguggagggcaaguccugcaucaaccggugcuucuacgucgagcugauccgcggccgcccccaggagacccgggugugguggaccagcaacuccaucguggucuucugcgggaccagcggcacguacgggaccggcuccuggcccgacggggccaacaucaacuucaugcccaucuga

SEQ ID NO: 77476 - RNA, 1410 nt, Artificial Sequence; identical to SEQ ID NO: 77475
  derived and/or modified sequence opt1 from neuraminidase__InfluenzaA__ACF54513

SEQ ID NO: 77477 - RNA, 1410 nt, Artificial Sequence
  derived and/or modified sequence opt1 from neuraminidase__InfluenzaA__ACF54524
augaaccccaaccagaagaucaucaccaucggcagcgugucccugaccaucgccacggucugcuucuucaugcagaucgccauccucgcgaccaccgugacccugcacuucaagcagcacgagugcgacagcccggccuccaaccaggugaugcccugcgagcccaucaucaucgagcgcaacaucacggagaucgucuaccugaacaacaccaccaucgagaaggagaucugccccgaggugguggaguaccggaacuggagcaagccgcagugccagaucaccggguucgcccccuucuccaaggacaacagcauccgccucuccgccggcggggacaucugggucacgcgggagcccuacgugagcugcgaccccggcaagugcuaccaguucgcccuggggcagggcaccacccuggacaacaagcacuccaacggcaccauccacgaccgcaucccgcaccggacgcuccugaugaacgagcugggggugagcuuccaccucggcaccaagcaggucugcguggcgugguccagcuccagcugccacgacgggaaggccuggcugcacgugugcgucaccggcgacgaccgcaacgccaccgccuccuucaucuacgacgggcggcugguggacagcaucggcuccuggagccagaacauccuccgcacgcaggaguccgagugcgugugcaucaacgggaccugcaccgucgugaugaccgacggcagcgcgagcggccgggccgacacgcgcauccuguucaucaaggaggggaagaucgugcacaucagcccccuguccggcuccgcccagcacaucgaggagugcagcugcuacccccgguaccccgacguccgcugcaucugccgggacaacuggaagggcuccaaccgcccggugaucgacaucaacauggaggacuacagcaucgacuccagcuacgugugcuccgggcucgucggcgacacgccccggaacgacgacagcuccagcaacuccaacugccgcgaccccaacaacgagcgggggaaccccggcgugaaggggugggccuucgacaacggcgacgacguguggaugggccgcaccaucaacaaggacagccgguccggguacgagaccuucaaggucaucggcggguggagcaccccgaacuccaagagccaggugaaccgccaggucaucguggacaacaacaacugguccggcuacagcgggaucuucagcguggagggcaaguccugcaucaaccggugcuucuacgucgagcugauccgcggccgcccccaggagacccgggugugguggaccagcaacuccaucguggucuucugcgggaccagcggcacguacgggaccggcuccuggcccgacggggccaacaucaacuucaugcccaucuga

SEQ ID NO: 77478 - RNA, 1410 nt, Artificial Sequence
  derived and/or modified sequence opt1 from neuraminidase__InfluenzaA__ACF54535
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccaagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77479 - RNA, 1410 nt, Artificial Sequence; identical to SEQ ID NO: 75292
  derived and/or modified sequence opt1 from neuraminidase__InfluenzaA__ACF54557

SEQ ID NO: 77480 - RNA, 1410 nt, Artificial Sequence; identical to SEQ ID NO: 76937
  derived and/or modified sequence opt1 from neuraminidase__InfluenzaA__ACF54568

SEQ ID NO: 77481 - RNA, 1410 nt, Artificial Sequence
  derived and/or modified sequence opt1 from neuraminidase__InfluenzaA__ACF54579
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaucaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77482 - RNA, 1362 nt, Artificial Sequence
  derived and/or modified sequence opt1 from neuraminidase__InfluenzaA__ACF54601
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccagggguccaucaccuacaaggugguggccggccaggacagcaccuccgucauccugaccggcaacagcucccugugcccgauccgcgggugggccauccacagcaaggacaacggcauccggaucggguccaagggcgacguguucgugauccgcgagcccuucaucagcugcucccaccucgagugccggacguucuuccugacccagggggcgcugcucaacgacaagcacagccgcggcaccuucaaggaccggucccccuaccgcgcccugaugagcugccccgucggcgaggccccgucccccuacaacagccgguucgaguccguggccuggagcgccagcgcgugccacgacgggaugggcuggcugaccaucgggaucuccggccccgacgacggcgccguggccguccucaaguacaacgggaucaucacggagaccaucaagagcuggcgcaagaacauccugcggacccaggaguccgagugcacgugcgugaacggcagcugcuucaccaucaugaccgacgggcccuccgacggccuggccagcuacaagaucuucaagaucgagaaggggaaggugaccaaguccaucgagcucaacgcgccgaacagccacuacgaggagugcuccugcuaccccgacaccggcaaggucaugugcgugugccgcgacaacuggcacggcagcaaccggcccuggguguccuucgaccagaaccuggacuacaagaucggguacaucugcagcggcgucuucggggacaacccccgcccgaaggacggcacgggguccugcggccccgugagcgccgacggcgccaacggggugaagggcuucuccuacaaguacgggaacggcgucuggaucgggcggaccaagagcgacuccagccgccacggcuucgagaugaucugggaccccaacggcuggaccgagaccgacucccgguucagcaugcgccaggacgugguggccaugacggaccggagcggguacuccggcagcuucguccagcaccccgagcugaccgggcucgacugcaugcgcccgugcuucuggguggagcugauccggggccugcccgaggagaacgccaucuggaccuccggcagcaucaucuccuucugcggggugaacagcgacaccgucgacugguccuggcccgacggcgcggagcuccccuucacgaucgacaaguga

SEQ ID NO: 77483 - RNA, 1350 nt, Artificial Sequence
  derived and/or modified sequence opt1 from neuraminidase__InfluenzaA__ACG50700
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgaucuccaacacgaacuuccugaccgagaaggccguggcgagcgucacccuggccggcaacagcccccucugccccaucuccgggugggccgugcacuccaaggacaacagcauccgcaucggcuccaagggcgacguguucgucauccgggagcccuucaucagcugcucccaccuggagugccgcaccuucuuccugacgcagggggcccuccugaacgacaagcacagcaacggcaccgugaaggaccgguccccgcaccgcacccugaugagcugccccgugggggaggcccccucccccuacaacagccgguucgaguccgucgcguggagcgccagcgccugccacgacggcaccuccuggcucacgaucgggaucagcggcccggacaacggcgccguggcggugcugaaguacaacgggaucaucaccgacaccaucaaguccuggcgcaacaacauccugcggacccaggagagcgagugcgccugcgucaacggcuccugcuucacggugaugaccgacgggcccagcaacggccaggccuccuacaagaucuucaagauggagaagggcaagguggucaagagcguggagcucgacgcccccaacuaccacuacgaggagugcuccugcuaccccgacgccagcgaggugaccugcgucugccgcgacaacuggcacggguccaaccggccgugggugagcuucaaccagaaccuggaguaccagaucggcuacaucugcuccgggguguucggcgacaacccccgccccaacgacgggaccggcagcugcggccccgucuccacgaacggggcguacggcgugaagggguucagcuucaaguacggcaacgggguguggaucggccggaccaaguccaccaacagccgcuccggcuucgagaugaucugggacagcaacggguggaccggcacggacagcuccuucagcgucaagcaggacaucguggccaucaccgacugguccggguacagcggcuccuucguccagcacccggagcugaccgggcucgacugcauccggcccugcuucuggguggagcugauccgcggccggcccaaggagagcaccaucuggacguccggcagcuccaucagcuucugcggggugaacuccgacaccgucggcuggagcuggcccgacggggccgagcugccguucaccaucgacaaguga

SEQ ID NO: 77484 - RNA, 1410 nt, Artificial Sequence; identical to SEQ ID NO: 77065
  derived and/or modified sequence opt1 from neuraminidase__InfluenzaA__ACG70145

SEQ ID NO: 77485 - RNA, 1410 nt, Artificial Sequence; identical to SEQ ID NO: 76892
  derived and/or modified sequence opt1 from neuraminidase__InfluenzaA__ACG70156

SEQ ID NO: 77486 - RNA, 1410 nt, Artificial Sequence
  derived and/or modified sequence opt1 from neuraminidase__InfluenzaA__ACG80407
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccaaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgcccgcggccggaccccguaccgcacccugcucaugaacgagcugggcgugcccuuccaccuggggacgaagcaggucugcaucgccuggagcuccagcuccugccacgacggcaaggcguggcuccacgugugcaucaccggggacgacaagaacgccaccgccagcuucaucuacaacggccggcugguggacuccgucgugagcugguccaaggagauccugcgcacccaggagagcgagugcgugugcaucaacgggacgugcaccgucgugaugaccgacggcuccgccagcggcgaggcggacaccaagauccucuucaucgaggaggggaagaucgugcacacgagcacccuguccggcagcgcccagcacgucgaggagugcuccugcuacccccgguaccccggggugcgcugcgugugccgggacaacuggaagggcagcaaccgcccgaucgucgacaucaacaucaaggaccacuccaucgugagcuccuacgugugcagcggccuggucggggacacgccccggaagaacgacuccagcuccagcucccacugccucgaccccaacaacgaggagggcgggcacggcgugaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucgucgaccgggggaaccgcagcggcuacuccgggaucuucagcguggagggcaagagcugcaucaaccggugcuucuacguggagcucauccgcggccggaaggaggagaccgagguccuguggaccuccaacagcaucgugguguucugcgggaccuccggcacguacgggaccggcagcuggccggacggggccgacaucaaccugaugcccaucuga

SEQ ID NO: 77487 - RNA, 1410 nt, Artificial Sequence
  derived and/or modified sequence opt1 from neuraminidase__InfluenzaA__ACG80411
auggacagcaacuccaagaucaucaccaucggcagcgugucccugaccaucagcacgaucugcuucuucaugcagaucgccauccucaucaccaccgucacccugcacuucaagcaguacgaguucaacagcccgcccaacaaccagaugaugcugugcgagcccacgaucaucgagcgcaacaucaccgagaucguguaccucaccaacaccacgaucgagaaggagaucugccccaagcuggccgaguaccggaacuggagcaagccccagugcgacaucaccggguucgcgccguucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgccggcggccgcacccccuaccggacccugcucaugaacgagcugggggugccguuccaccugggcacgaagcaggucugcaucgccuggagcuccagcuccugccacgacgggaaggcguggcuccacgugugcaucaccggcgacgacaagaacgccaccgccagcuucaucuacgacgggcgccugguggacggcgucguguccuggagcaaggagauccugcggacccaggaguccgagugcgugugcaucaacggcacgugcaccgucgugaugaccgacgggagcgccagcggcgaggcggacaccaagauccucuucaucgaggaggggaagaucgugcacacguccacccugagcggcuccgcccagcacgucgaggagugcagcugcuacccccgcuaccccggcgugcggugcgugugccgcgacaacuggaagggguccaaccggcccaucgucgacaucaacaucaaggaccacagcaucguguccagcuacgugugcuccggccuggucggggacaccccgcgcaagaacgacagcuccagcuccagccacugccucgaccccaacaacgaggagggcgggcacggcgugaagggcugggccuucgacgacgggaacgacguguggaugggccggaccaucuccgagaagucccgccugggguacgagacguucaaggucaucgagggcugguccaaccccaagagcaagcugcagaucaaccgccaggugaucgucgaccgggggaaccgguccggcuacagcggcaucuucagcguggaggggaaguccugcaucaaccgcugcuucuacguggagcucauccggggccgcaaggaggagaccgagguccuguggaccagcaacuccaucgugguguucugcgggaccagcggcacguacgggaccggcuccuggcccgacggcgccgacaucaaccugaugccgaucuga

SEQ ID NO: 77488 - RNA, 1407 nt, Artificial Sequence
  derived and/or modified sequence opt1 from neuraminidase__InfluenzaA__ACG80421
augaaccccauccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccgacaccgcccgcgaccggaccccguaccgcacccugcucaugaacgagcugggcgugcccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcgaggcggacaccaagauccucuucaucgaggagggcaagaucgugcacacgagcacccuguccgggagcgcccagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 77489 - RNA, 1407 nt, Artificial Sequence
  derived and/or modified sequence opt1 from neuraminidase__InfluenzaA__ACG80427
auggaccccaacagcaagaucaucaccaucggcuccgugagccugaccaucuccacgaucugcuucuucaugcagaucgccauccucaucaccaccgucacccugcacuucaagcaguacgaguucaacagcccgcccaacaaccagaugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggugacccgggagcccuacgucuccugcgaccccgacaagugcuaccaguucgcccucggccaggggaccacgcugaacaacgugcacagcgacaccgcccgcgaccggaccccguaccgcacccugcucaugaacgagcugggcgugcccuuccaccugggcacgaagcaggucugcaucgccugguccagcuccagcugccacgacgggaaggcguggcuccacgugugcaucaccggcgacgacaagaacgccaccgccuccuucaucuacaacgggcggcugguggacagcgucguguccuggagcaaggagauccugcgcacccaggaguccgagugcgugugcaucaacggcacgugcaccgucgugaugaccgacgggagcgccagcggcgaggcggacaccaagauccucuucaucgaggagggcaagaucgugcacacguccacccugagcggguccgcccagcacgucgaggagugcagcugcuacccccgguaccccggcgugcgcugcgugugccgggacaacuggaagggguccaaccgcccgaucgucgacaucaacaucaaggaccacagcaucguguccagcuacgugugcuccggccuggucggcgacacgccccggaagaacgacagcuccagcuccagccacugccucgaccccaacaacgaggagggcgggcacggggugaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucgucgaccggggcaaccgcuccggguacagcggcaucuucagcguggaggggaaguccugcaucaaccggugcuucuacguggagcucauccgcggccggaaggaggagaccgagguccuguggaccagcaacuccaucgugguguucugcggcaccagcgggacguacggcaccggguccuggccggacggcgccgacaucaaccugaugcccaucuga

SEQ ID NO: 77490 - RNA, 1410 nt, Artificial Sequence
  derived and/or modified sequence opt1 from neuraminidase__InfluenzaA__ACG80437
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccaacuucaucuacaacgggcggcugguggacuccaucgugagcugguccaaggagaucuuccgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguaccccggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucagcgagaagucccggagcggcuacgagacguucaaggugaucgaggggugguccaaccccaagagcaagcuccagaucaaccgccaggucaucguggaccggggcaaccgcuccggguacagcggcaucuucagcguggaggggaaguccugcaucaaccggugcuucuacgucgagcugauccgcggccggaaggaggagaccgaggugcuguggaccagcaacuccaucguggucuucugcggcaccagcgggacguacggcaccggguccuggcccgacggcgccgacaucaaccucaugccgaucuga

SEQ ID NO: 77491 - RNA, 1407 nt, Artificial Sequence
  derived and/or modified sequence opt1 from neuraminidase__InfluenzaA__ACG80446
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccgacaccgcccgcgaccggaccccguaccgcacccugcucaugaacgagcugggcgugcccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcgaggcggacaccaagauccucuucaucgaggagggcaagaucgugcacacgagcacccuguccgggagcgcccagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 77492 - RNA, 1410 nt, Artificial Sequence
  derived and/or modified sequence opt1 from neuraminidase__InfluenzaA__ACG80455
augaaccccaaccagaagaucaucaccaucggcagcguguccuucaucaucagcuccaucugcuucuucaugcagaucgccauccugaucaccacggucacccuccacuucaagcaguacgaguucaacagcccgcccaacaaccagaugaugcugugcgagcccaccaucaucgagcgcaacaucaccgagaucguguaccugacgaacaccaccaucgagaaggagaucugccccaagcucgccgaguaccggaacugguccaagccgcagugcgacaucaccggguucgcgcccuucagcaaggacaacuccauccgccugagcgccggcggggacaucugggugacgcgggagcccuacgucuccugcgaccccgacaagugcuaccaguucgcccugggccaggggaccacccucaacaacgugcacagcaacgacaccgcccgcggccggacgccguaccgcacccugcugaugaacgagcucggcgugcccuuccaccuggggaccaagcaggucugcaucgccugguccagcuccagcugccacgacggcaaggcguggcugcacgugugcaucaccggggacgacaagaacgccacggccuccuucaucuacgacggccggcucguggacagcgucguguccuggagcaaggagauccugcgcacccaggaguccgagugcgugugcaucaacgggaccugcaccgucgugaugacggacggcagcgccagcggcgaggcggacaccaagauccuguucaucgaggaggggaagaucgugcacaccuccacccucagcggcuccgcccagcacgucgaggagugcagcugcuacccccgguaccccggggugcgcugcgugugccgggacaacuggaagggcuccaaccgcccgaucgucgacaucaacaucaaggaccacagcaucguguccagcuacgugugcuccggccuggucggggacacgccccggaagaacgacagcuccagcuccagccacugccuggaccccaacaacgaggagggcgggcacggcgugaaggggugggccuucgacgacggcaacgacguguggaugggccgcaccaucuccgagaagucccggcucggguacgagaccuucaaggucaucgagggcuggagcaaccccaagagcaagcugcagaucaaccgccaggugaucgucgaccgggggaaccgcuccggcuacagcgggaucuucagcguggagggcaaguccugcaucaaccggugcuucuacguggagcugauccgcggccggaaggaggagaccgagguccucuggacgagcaacuccaucgugguguucugcgggaccagcggcaccuacgggaccggcuccuggccggacggggccgacaucaaccugaugcccaucuga

SEQ ID NO: 77493 - RNA, 1407 nt, Artificial Sequence; identical to SEQ ID NO: 77491
  derived and/or modified sequence opt1 from neuraminidase__InfluenzaA__ACG80464

SEQ ID NO: 77494 - RNA, 1410 nt, Artificial Sequence
  derived and/or modified sequence opt1 from neuraminidase__InfluenzaA__ACG80473
auggaccccauccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgcccgcggccggaccccguaccgcacccugcucaugaacgagcugggcgugcccuuccaccuggggacgaagcaggucugcaucgccuggagcuccagcuccugccacgacggcaaggcguggcuccacgugugcaucaccggggacgacaagaacgccaccgccagcuucaucuacgacggccggcugguggacuccgucgugagcugguccaaggagauccugcgcacccaggagagcgagugcgugugcaucaacgggacgugcaccgucgugaugaccgacggcuccgccagcggcgaggcggacaccaagauccucuucaucgaggaggggaagaucgugcacacgagcacccuguccggcagcgcccagcacgucgaggagugcuccugcuacccccgguaccccggggugcgcugcgugugccgggacaacuggaagggcagcaaccgcccgaucgucgacaucaacaucaaggaccacuccaucgugagcuccuacgugugcagcggccuggucggggacacgccccggaagaacgacuccagcuccagcucccacugccucgaccccaacaacgaggagggcgggcacggcgugaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucgucgaccgggggaaccgcagcggcuacuccgggaucuucagcguggagggcaagagcugcaucaaccggugcuucuacguggagcucauccgcggccggaaggaggagaccgagguccuguggaccuccaacagcaucgugguguucugcgggaccuccggcacguacgggaccggcagcuggccggacggggccgacaucaaccugaugcccaucuga

SEQ ID NO: 77495 - RNA, 1410 nt, Artificial Sequence; identical to SEQ ID NO: 75720
  derived and/or modified sequence opt1 from neuraminidase__InfluenzaA__ACH69559

SEQ ID NO: 77496 - RNA, 1410 nt, Artificial Sequence
  derived and/or modified sequence opt1 from neuraminidase__InfluenzaA__ACH69570
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaacaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77497 - RNA, 1410 nt, Artificial Sequence; identical to SEQ ID NO: 75720
  derived and/or modified sequence opt1 from neuraminidase__InfluenzaA__ACH69581

SEQ ID NO: 77498 - RNA, 1410 nt, Artificial Sequence
  derived and/or modified sequence opt1 from neuraminidase__InfluenzaA__ACH69592
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagucccgcagcggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccagugcuucuacguggagcucauccgcgggcggaagcaggagaccgaggugcuguggaccuccaacagcaucgucguguucugcggcaccuccgggaccuacggcacggggagcuggcccgacggcgccgaccugaaccucaugcccaucuga

SEQ ID NO: 77499 - RNA, 1410 nt, Artificial Sequence
  derived and/or modified sequence opt1 from neuraminidase__InfluenzaA__ACH69603
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacgagaacgcgaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggccgacaccaagauccuguucaucgaggagggcaagaucgugcacacgagcccccugagcggguccgcgcagcacguggaggagugcagcugcuacccccgcuacccgggcguccggugcgugugccgcgacaacuggaagggcuccaaccggcccaucguggacaucaacgucaaggacuacagcaucguguccagcuacgugugcuccgggcucgucggcgacacgccccgcaagaacgacagcuccagcuccagccacugccuggaccccaacaacgaggagggcgggcacggggugaagggcugggccuucgacgacggcaacgacgucuggauggggcggaccaucuccgagaagucccgcagcggcuacgagaccuucaaggugaucgagggguggagcaagccgaacuccaagcugcagaucaaccgccaggugaucgucgaccggggcaaccggagcggguacuccggcaucuucagcguggagggcaagagcugcaucaaccgcugcuucuacguggagcucauccgggggcgcaagcaggagaccgagguccuguggaccuccaacagcaucgugguguucugcggcaccuccgggaccuacggcacggggagcuggcccgacggcgccgaccugaaccucaugcccaucuga

SEQ ID NO: 77500 - RNA, 1410 nt, Artificial Sequence
  derived and/or modified sequence opt1 from neuraminidase__InfluenzaA__ACH69614
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagucccgcagcggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggcccgacggcgccgaccugaaccucaugcccaucuga

SEQ ID NO: 77501 - RNA, 1413 nt, Artificial Sequence
  derived and/or modified sequence opt1 from neuraminidase__InfluenzaA__ACI22525
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcgcauccugcggacccaggagagcgagugcgugugcaugaacggcuccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggguacaucugcagcggcgucuucggcgacaacccccgccccaaggacggggagggcuccugcaacccggugacgguggacggggcggacggcgucaagggguucagcuacaaguacggcaacggcguguggaucgggcggaccaaguccaaccgccugcggaagggcuucgagaugaucugggaccccaacggguggaccaacaccgacagcgacuucuccgugaagcaggacgucguggccaucacggacuggagcggcuacagcggguccuucgugcagcaccccgagcucaccggccuggacugcauccgccccugcuucugggucgagcuggugcggggccucccgcgcgagaacaccaccaucuggacgagcggguccagcaucuccuucugcggcgucaacagcgacaccgccaacugguccuggcccgacggggccgagcugcccuucaccaucgacaaguga

SEQ ID NO: 77502 - RNA, 1413 nt, Artificial Sequence; identical to SEQ ID NO: 77501
  derived and/or modified sequence opt1 from neuraminidase__InfluenzaA__ACI22526

SEQ ID NO: 77503 - RNA, 1413 nt, Artificial Sequence; identical to SEQ ID NO: 77501
  derived and/or modified sequence opt1 from neuraminidase__InfluenzaA__ACI22527

SEQ ID NO: 77504 - RNA, 1413 nt, Artificial Sequence; identical to SEQ ID NO: 77501
  derived and/or modified sequence opt1 from neuraminidase__InfluenzaA__ACI22528

SEQ ID NO: 77505 - RNA, 1413 nt, Artificial Sequence; identical to SEQ ID NO: 77501
  derived and/or modified sequence opt1 from neuraminidase__InfluenzaA__ACI22529

SEQ ID NO: 77506 - RNA, 1413 nt, Artificial Sequence; identical to SEQ ID NO: 77501
  derived and/or modified sequence opt1 from neuraminidase__InfluenzaA__ACI22530

SEQ ID NO: 77507 - RNA, 1413 nt, Artificial Sequence
  derived and/or modified sequence opt1 from neuraminidase__InfluenzaA__ACI22532
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcaugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 77508 - RNA, 1413 nt, Artificial Sequence; identical to SEQ ID NO: 77507
  derived and/or modified sequence opt1 from neuraminidase__InfluenzaA__ACI22533

SEQ ID NO: 77509 - RNA, 1413 nt, Artificial Sequence; identical to SEQ ID NO: 77501
  derived and/or modified sequence opt1 from neuraminidase__InfluenzaA__ACI22534

SEQ ID NO: 77510 - RNA, 1410 nt, Artificial Sequence
  derived and/or modified sequence opt1 from neuraminidase__InfluenzaA__ACI25727
augaaccccaaccagaagaucaucaccaucggcagcgugucccugaccaucgccacggucugcuuccucaugcagaucgccauccuggugaccaccgugacccugcacuucaagcagcacgagugcaacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucaaggagggcaagaucgugcacaucagcccccucuccgggagcgcccagcacguggaggagugcuccugcuacccccgguacccgggcguccgcugcaucugccgggacaacuggaagggcagcaaccgccccgugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcaccccgaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggcccgacggggccaacaucaacuucaugcccaucuga

SEQ ID NO: 77511 - RNA, 1410 nt, Artificial Sequence
  derived and/or modified sequence opt1 from neuraminidase__InfluenzaA__ACI25749
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcacaucuga

SEQ ID NO: 77512 - RNA, 1410 nt, Artificial Sequence; identical to SEQ ID NO: 77511
  derived and/or modified sequence opt1 from neuraminidase__InfluenzaA__ACI25760

SEQ ID NO: 77513 - RNA, 1410 nt, Artificial Sequence; identical to SEQ ID NO: 77511
  derived and/or modified sequence opt1 from neuraminidase__InfluenzaA__ACI25771

SEQ ID NO: 77514 - RNA, 1410 nt, Artificial Sequence; identical to SEQ ID NO: 75103
  derived and/or modified sequence opt1 from neuraminidase__InfluenzaA__ACI25782

SEQ ID NO: 77515 - RNA, 1410 nt, Artificial Sequence
  derived and/or modified sequence opt1 from neuraminidase__InfluenzaA__ACI25793
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgugggcggggacaucugggugacgcgggagcccuacgucagcugcgaccacggcaagugcuaccaguucgcccuggggcagggcaccacccucgacaacaagcacuccaacgacaccauccacgaccgcaucccccaccggacgcugcugaugaacgagcucggcgugccguuccaccuggggacccgccaggugugcaucgccuggagcuccagcuccugccacgacggcaaggccuggcugcacgucugcaucaccggggacgacaagaacgcgaccgccagcuucaucuacgacggccggcucguggacuccaucgggagcuggucccagaacauccugcgcacgcaggagagcgagugcgugugcaucaacgggaccugcaccgucgugaugaccgacggcuccgccagcggccgggccgacacgcgcauccuguucaucgaggagggcaagaucgugcacaucagcccccucuccgggagcgcgcagcacgucgaggagugcuccugcuacccccgguaccccggcgugcgcugcaucugccgggacaacuggaagggcagcaaccgcccgguggucgacaucaacauggaggacuacuccaucgacagcuccuacgugugcagcgggcuggugggcgacacgccccggaacgacgaccgcuccagcaacuccaacugccggaaccccaacaacgagcgcgggaaccagggcgucaaggggugggccuucgacaacggcgacgacguguggaugggccggaccaucagcaaggaccugcgcuccggguacgagaccuucaaggucaucggcggguggagcacccccaacuccaagagccagaucaaccgccaggugaucguggacuccgacaaccggagcggcuacuccgggaucuucagcgucgagggcaagagcugcaucaaccgcugcuucuacguggagcucauccggggccgcaagcaggagacccgggugugguggaccuccaacagcaucgucguguucugcgggaccuccggcacguacgggaccggcagcuggccggacggggccaacaucaacuucaugcccaucuga

SEQ ID NO: 77516 - RNA, 1410 nt, Artificial Sequence
  derived and/or modified sequence opt1 from neuraminidase__InfluenzaA__ACI25804
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgaccaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 77517 - RNA, 1410 nt, Artificial Sequence; identical to SEQ ID NO: 77475
  derived and/or modified sequence opt1 from neuraminidase__InfluenzaA__ACI26277

SEQ ID NO: 77518 - RNA, 1410 nt, Artificial Sequence; identical to SEQ ID NO: 75335
  derived and/or modified sequence opt1 from neuraminidase__InfluenzaA__ACI26299

SEQ ID NO: 77519 - RNA, 1410 nt, Artificial Sequence
  derived and/or modified sequence opt1 from neuraminidase__InfluenzaA__ACI26321
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaccgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 77520 - RNA, 1410 nt, Artificial Sequence
  derived and/or modified sequence opt1 from neuraminidase__InfluenzaA__ACI26354
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77521 - RNA, 1410 nt, Artificial Sequence
  derived and/or modified sequence opt1 from neuraminidase__InfluenzaA__ACI26365
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccugaccggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggaggggguccacggcgugaaggggugggccuucgacgacggcaacgacgucuggauggggcgcaccaucuccgagaagucccggcugggcuacgagaccuucaaggugaucgagggcuggagcaaccccaagagcaagcugcagaucaaccgccaggugaucgucgaccgggggaaccgcuccggcuacagcgggaucuucuccguggagggcaagagcugcaucaaccggugcuucuacguggagcucauccgcgggcggaaggaggagaccgagguccuguggaccagcaacuccaucgugguguucugcggcacgagcggcaccuacgggaccggcuccuggccggacggggccgacaucaaccugaugcccaucuga

SEQ ID NO: 77522 - RNA, 1410 nt, Artificial Sequence; identical to SEQ ID NO: 77520
  derived and/or modified sequence opt1 from neuraminidase__InfluenzaA__ACI26376

SEQ ID NO: 77523 - RNA, 1410 nt, Artificial Sequence; identical to SEQ ID NO: 77412
  derived and/or modified sequence opt1 from neuraminidase__InfluenzaA__ACI26387

SEQ ID NO: 77524 - RNA, 1410 nt, Artificial Sequence; identical to SEQ ID NO: 77424
  derived and/or modified sequence opt1 from neuraminidase__InfluenzaA__ACI26420

SEQ ID NO: 77525 - RNA, 1410 nt, Artificial Sequence; identical to SEQ ID NO: 75335
  derived and/or modified sequence opt1 from neuraminidase__InfluenzaA__ACI26431

SEQ ID NO: 77526 - RNA, 1413 nt, Artificial Sequence
  derived and/or modified sequence opt1 from neuraminidase__InfluenzaA__ACI26442
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugcaagacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagagcgagugcgugugcaugaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggcuacaucugcagcggggucuucggcgacaacccccgccccaaggaccgggagggguccugcaacccggugacgaucgacggcgcggacggggugaagggcuucagcuacaaguacggcaacggggucuggaucggccgcaccaaguccaaccggcugcgcaagggguucgagaugaucugggaccccaacggcuggaccaacaccgacagcgacuucuccgugaagcaggacguggucgccaucacggacuggagcggguacagcggcuccuucgugcagcaccccgagcucaccggccuggacugcauccggcccugcuucuggguggagcugguccgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 77527 - RNA, 1413 nt, Artificial Sequence; identical to SEQ ID NO: 77526
  derived and/or modified sequence opt1 from neuraminidase__InfluenzaA__ACI26453

SEQ ID NO: 77528 - RNA, 1410 nt, Artificial Sequence
  derived and/or modified sequence opt1 from neuraminidase__InfluenzaA__ACI26464
augaaccccaaccagaagaucaucaccaucggcagcgugucccugaccaucagcacgaucugcuucuucaugcagaucgccauccucaucgccaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccaucgugagcugguccaaggagauccugcgcacccaggagagcgagugcgucugcaucaacgggaccugcacgguggugaugaccgacggguccgccagcggcaaggcggacaccaagauccucuucaucgaggagggcaagaucguccacaccagcacgcuguccgggagcgcccagcacguggaggagugcuccugcuacccccgguaccccggcgugcgcugcgucugccgggacaacuggaaggggagcaaccgcccgaucguggacaucaacaucaaggaccacuccaccgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77529 - RNA, 1410 nt, Artificial Sequence; identical to SEQ ID NO: 77519
  derived and/or modified sequence opt1 from neuraminidase__InfluenzaA__ACI26475

SEQ ID NO: 77530 - RNA, 1410 nt, Artificial Sequence; identical to SEQ ID NO: 77520
  derived and/or modified sequence opt1 from neuraminidase__InfluenzaA__ACI26486

SEQ ID NO: 77531 - RNA, 1410 nt, Artificial Sequence; identical to SEQ ID NO: 77520
  derived and/or modified sequence opt1 from neuraminidase__InfluenzaA__ACI26497

SEQ ID NO: 77532 - RNA, 1410 nt, Artificial Sequence; identical to SEQ ID NO: 77520
  derived and/or modified sequence opt1 from neuraminidase__InfluenzaA__ACI26508

SEQ ID NO: 77533 - RNA, 1410 nt, Artificial Sequence
  derived and/or modified sequence opt1 from neuraminidase__InfluenzaA__ACI26519
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 77534 - RNA, 1410 nt, Artificial Sequence; identical to SEQ ID NO: 77520
  derived and/or modified sequence opt1 from neuraminidase__InfluenzaA__ACI26530

SEQ ID NO: 77535 - RNA, 1410 nt, Artificial Sequence; identical to SEQ ID NO: 77520
  derived and/or modified sequence opt1 from neuraminidase__InfluenzaA__ACI26541

SEQ ID NO: 77536 - RNA, 1410 nt, Artificial Sequence
  derived and/or modified sequence opt1 from neuraminidase__InfluenzaA__ACI26552
augaaccccaaccagaagaucaucaccaucggcagcgugucccugaccaucgccacgaugugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucagcgaggagcuccgcuccggcuacgagaccuucaaggugaucgggggcuggagcacccccaacuccaagcugcagaucaaccgccaggugaucgucgacagcgggaaccgguccggcuacagcgggaucuucagcguggagggcaaguccugcaucaaccggugcuucuacguggagcugauccgcggccgcgagcaggagacgcgggucugguggaccagcaacuccaucgugguguucugcgggaccagcggcaccuacgggacgggcuccuggcccgacggggccgacaucaaccucaugcccaucuga

SEQ ID NO: 77537 - RNA, 1410 nt, Artificial Sequence
  derived and/or modified sequence opt1 from neuraminidase__InfluenzaA__ACI26574
augaaccccaaccagaagaucaucaccaucggcagcgugucccugacccucgccacgaucugcuuccugaugcagaucgccauccuggucaccaccgugacccuccacuucaagcaguacgagugcagcuccccgcccaacaaccaggugaugcccugcgagcccacgaucaucgagcgcaacaucaccgagaucgucuaccugaccaacaucaccaucgagaaggagaucugcccgaagcugguggaguaccggaacuggagcaagccccagugcaagaucacgggguucgcgcccuucuccaaggacaacagcauccgccucuccgccggcggggacaucugggugacccgggagcccuacgucagcugcgacccguccaagugcuaccaguucgcccugggccaggggaccacccugaacaaccgccacagcaacgacacggugcacgaccggacccccuaccgcacccuccugaugaacgagcugggcgugcccuuccaccucggcacccggcaggucugcauggccugguccagcuccagcugccacgacgggaaggccuggcugcacgugugcgugacgggccacgacgagaacgcgaccgccuccuucaucuacgacgggcgccuggucgacagcaucggcuccuggagcaagaacauccuccggacccaggaguccgagugcgugugcaucaacgggaccugcacgguggucaugaccgacggcagcgccagcgagcgcgccgacaccaagauccuguucaucgaggagggcaagaucgugcacaucagcccccuguccggguccgcgcagcacguggaggagugcagcugcuacccgcgguaccccggcguccgcugcgugugccgggacaacuggaagggguccaaccgccccaucguggacaucaacgucaaggacuacagcaucguguccagcuacgugugcuccggccucgucggcgacacgccccggaagaacgaccgcagcuccagcuccuacugccggaacccgaacaacgagaaggggagccacggcgugaaggggugggccuucgacgacggcaacgacgucuggauggggcgcaccaucggcgaggagcugcgguccggcuacgagaccuucaaggugaucgggggcuggagcacccccaacuccaagcugcagaucaaccgccaggugaucgucgacagcgggaaccgguccggcuacagcgggaucuucagcguggagggcaaguccugcaucaaccgcugcuucuacguggagcucauccgcggccggaagcaggagacccgcgucugguggacgagcaacuccaucgugguguucugcgggaccagcggcaccuacgggaccggcuccuggcccgacggggccgacaucaaccugaugcccaucuga

SEQ ID NO: 77538 - RNA, 1410 nt, Artificial Sequence
  derived and/or modified sequence opt1 from neuraminidase__InfluenzaA__ACI26585
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucguguccuggagcaagaacgugcugcgcacccaggaguccgagugcgucugcaucaacgggacgugcaccguggugaugaccgacggcagcgccuccgagcgggccgacaccaagauccucuucaucgaggagggcaagaucguccacaucagcccccugagcggguccgcgcagcacguggaggagugcagcugcuacccgcgcuaccccggcgugcggugcgucugccgcgacaacuggaagggguccaaccggcccaucguggacaucaacgugaaggacuacagcaucgucuccagcuacgugugcuccggccuggucggcgacacgccccgcaagaacgacagcuccagcuccagcuacugccggaacccgaacaacgagaaggggucccacggcgugaaggggugggccuucgacgacggcaacgacguguggauggggcgcaccaucggcgaggagcuccggagcggcuacgagaccuucaaggucaucgggggcugguccacccccaacagcaagcugcagacgaaccgccaggugaucguggaccgggggaaccgcuccggcuacagcgggaucuucuccgucgagggcaagagcugcaucaaccggugcuucuacguggagcugauccgcggccgcaagcaggagaccaaggugugguggaccagcaacuccaucgucguguucugcgggaccagcggcacguacgggaccggcuccuggcccgacggggccgacaucaaccucaugcccaucuga

SEQ ID NO: 77539 - RNA, 1413 nt, Artificial Sequence
  derived and/or modified sequence opt1 from neuraminidase__InfluenzaA__ACI32764
augaaccccaaccagaagaucaucaccaucggcagcaucuccauggccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77540 - RNA, 1413 nt, Artificial Sequence
  derived and/or modified sequence opt1 from neuraminidase__InfluenzaA__ACI32765
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacaacaccugggugaaccacaccuacgucaacaucaacaacacgaacgugguggcgcggaaggacaagaccuccgucacccuggccgggaacagcucccugugcagcaucuccggcugggccaucuacaccaaggacaacagcauccgcaucggcuccaagggggacguguucgugauccgggagccguucaucagcugcucccaccucgagugccgcacguucuucaugacccagggcgcccugcugaacgacaagcacagcaacgggaccgucaaggaccggucccccuaccgcgcccucaugagcugcccccugggcgaggcgcccuccccguacaacagcaaguucgagagcguggccugguccgccagcgccugccacgacgggaugggcuggcugaccaucggcaucuccgggcccgacaacggcgcgguggccguccucaaguacaacgggaucaucacggagaccaucaagagcuggaagaagcggauccugcgcacccaggaguccgagugcgugugcgugaacggcagcugcuucaccaucaugacggacggccccuccaacggggccgccagcuacaagaucuucaagaucgagaagggcaaggucaccaaguccguggagcugaacgcccccaacuuccacuacgaggagugcagcugcuacccggacaccgggaccgugaugugcgucugccgggacaacuggcacggcuccaaccgccccugggugagcuucaaccagaaccucgacuaccagaucggguacaucugcuccggcguguucggcgacaacccccggcccaaggacgggaagggcagcugcaacccggucacgguggacggggcggacggcgugaagggguucuccuacaaguacggcaacggcgucuggaucgggcgcaccaagagcaaccggcugcgcaagggcuucgagaugaucugggaccccaacggguggaccgacaccgacuccgacuucagcgugaagcaggacguggucgccaucacggacugguccggcuacagcgggagcuucgugcagcaccccgagcugaccggccucgacugcauccggcccugcuucugggucgagcuggugcgcggccugccgcgggagaacaccaccaucuggacguccgggagcuccaucagcuucugcggcguggacuccgacaccgccaacuggagcuggcccgacggggccgagcuccccuucaccaucgacaaguga

SEQ ID NO: 77541 - RNA, 1413 nt, Artificial Sequence; identical to SEQ ID NO: 75394
  derived and/or modified sequence opt1 from neuraminidase__InfluenzaA__ACI32766

SEQ ID NO: 77542 - RNA, 1413 nt, Artificial Sequence
  derived and/or modified sequence opt1 from neuraminidase__InfluenzaA__ACI32767
augaaccccaaccagaagaucaucaccaucggcagcaucuccaucgccaucgggaucaucagccugaugcuccagaucggcaacaucaucuccaucugggccagccacuccacccagacggggagccagaaccacaccggcaucugcaaccagcgcaucaucaccuacgagaacuccaccugggugaaccacacguacgucaacaucaacaacaccaacgugguggcggggaaggacaagaccagcgucacccuggccggcaacuccagccugugcuccaucagcggcugggccaucuacacgaaggacaacuccgugcggaucgggagcaagggcgacguguucgucauccgcgagccguucaucuccugcagccaccucgagugccggaccuucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcggucgccgugcugaaguacaacggcaucaucaccgagaccaucaaguccuggaagaagcgcauccugcggacccaggagagcgagugcgugugcgucaacggcuccugcuucacgaucaugaccgacgggcccagcaacggcgccgccuccuacaagaucuucaagaucgagaaggggaaggugaccaagagcaucgagcucaacgcccccaacuuccacuacgaggagugcuccugcuacccggacaccggcacggugaugugcgucugccgcgacaacuggcacgggagcaaccggcccuggguguccuucaaccagaaccuggacuaccagaucggcuacaucugcagcggcguguucggggacaacccccgccccaaggacggcaagggguccugcaacccggucaccguggacggcgcggacggggugaagggcuucagcuacaaguacggcaacggggucuggaucggccggaccaaguccaaccgccugcggaagggguucgagaugaucugggaccccaacggcuggaccgacacggacagcgacuucuccgugaagcaggacguggucgccaucaccgacuggagcggguacagcggcuccuucgugcagcaccccgagcucaccggccuggacugcauccgccccugcuucugggucgagcuggugcgggggcucccgcgcgagaacaccacgaucuggaccagcggcuccagcaucuccuucugcgggguggacagcgacaccgccaacugguccuggcccgacggcgccgagcugcccuucaccaucgacaaguga

SEQ ID NO: 77543 - RNA, 1413 nt, Artificial Sequence
  derived and/or modified sequence opt1 from neuraminidase__InfluenzaA__ACI32768
augaaccccaaccagaagaucaucaccaucggcagcaucuccaucgccaucgggaucaucagccugaugucccagaucggcaacaucaucagcaucugggccucccacagcauccagaccgggucccagaaccacacgggcaucugcaaccagcgcaucaucaccuacgagaacagcaccugggugaaccacaccuacgucaacaucaacaacacgaacgugguggcggggaaggacaagaccuccgucacccucgccggcaacagcucccugugcagcaucuccggcugggccaucuacaccaaggacaacagcauccggaucggguccaagggcgacguguucgugauccgcgagccguucaucagcugcucccaccuggagugccggacguucuuccucacccagggggcccugcugaacgacaagcacagcaacggcaccgucaaggaccgcucccccuaccgggcccucaugagcugcccccugggggaggcgcccagcccguacaacuccaaguucgagagcguggccugguccgccagcgccugccacgacggcaugggcuggcugaccaucgggaucuccggccccgacaacggggcgguggccguccucaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcugaacgcccccaacuuccacuacgaggagugcagcugcuacccggacaccggcaccgugaugugcgugugccgcgacaacuggcacggguccaaccggcccugggucagcuucaaccagaaccucgacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcugaccggccucgacugcauccgccccugcuucuggguggagcugguccgggggcugccgcgcgagaacaccaccaucuggacguccggcagcuccaucagcuucugcgggguggacuccgacaccgccaacuggagcuggcccgacggcgccgagcuccccuucaccaucgacaaguga

SEQ ID NO: 77544 - RNA, 1413 nt, Artificial Sequence
  derived and/or modified sequence opt1 from neuraminidase__InfluenzaA__ACI32769
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaucagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacagcgacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccagcggcuccagcaucuccuucugcgggguggacagcgacacggccaacugguccuggcccgacggcgccgagcugcccuucaccaucgacaaguga

SEQ ID NO: 77545 - RNA, 1413 nt, Artificial Sequence; identical to SEQ ID NO: 75394
  derived and/or modified sequence opt1 from neuraminidase__InfluenzaA__ACI32770

SEQ ID NO: 77546 - RNA, 1413 nt, Artificial Sequence
  derived and/or modified sequence opt1 from neuraminidase__InfluenzaA__ACI32771
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacaagaacuccaccugggugaaccacaccuacgucaacaucaacaacacgaacgugguggcggggaagggcaagaccagcgucacccuggccggcaacuccagccugugcuccaucagcgggugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacggcaugggguggcucaccaucggcaucagcgggcccgacaacggcgcgguggccguccugaaguacaacggcaucaucacggagaccaucaaguccuggaagaagcgcauccugcggacccaggagagcgagugcgugugcgugaacggguccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggcuacaucugcagcgggguguucggcgacaacccccgccccaaggacgggaagggcuccugcaacccggugacggucgacggggcggacggcgugaagggcuucagcuacaaguacgggaacggcguguggaucgggcggaccaaguccaaccgccugcggaagggcuucgagaugaucugggaccccaacggguggaccgacaccgacagcgacuucuccgucaagcaggacgugguggccaucacggacuggagcggcuacagcggcuccuucguccagcaccccgagcucaccgggcuggacugcauccgccccugcuucuggguggagcugguccggggccucccgcgcgagaacaccaccaucuggacgagcggguccagcaucuccuucugcggcguggacagcgacaccgccaacugguccuggcccgacggcgccgagcugcccuucaccaucgacaaguga

SEQ ID NO: 77547 - RNA, 1413 nt, Artificial Sequence; identical to SEQ ID NO: 75394
  derived and/or modified sequence opt1 from neuraminidase__InfluenzaA__ACI32772

SEQ ID NO: 77548 - RNA, 1413 nt, Artificial Sequence; identical to SEQ ID NO: 75394
  derived and/or modified sequence opt1 from neuraminidase__InfluenzaA__ACI32773

SEQ ID NO: 77549 - RNA, 1413 nt, Artificial Sequence; identical to SEQ ID NO: 75394
  derived and/or modified sequence opt1 from neuraminidase__InfluenzaA__ACI32774

SEQ ID NO: 77550 - RNA, 1413 nt, Artificial Sequence; identical to SEQ ID NO: 75394
  derived and/or modified sequence opt1 from neuraminidase__InfluenzaA__ACI32775

SEQ ID NO: 77551 - RNA, 1413 nt, Artificial Sequence
  derived and/or modified sequence opt1 from neuraminidase__InfluenzaA__ACI32776
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacaagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 77552 - RNA, 1413 nt, Artificial Sequence
  derived and/or modified sequence opt1 from neuraminidase__InfluenzaA__ACI32777
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacaagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucgccaucgacaaguga

SEQ ID NO: 77553 - RNA, 1413 nt, Artificial Sequence; identical to SEQ ID NO: 75394
  derived and/or modified sequence opt1 from neuraminidase__InfluenzaA__ACI32778

SEQ ID NO: 77554 - RNA, 1413 nt, Artificial Sequence; identical to SEQ ID NO: 75394
  derived and/or modified sequence opt1 from neuraminidase__InfluenzaA__ACI32779

SEQ ID NO: 77555 - RNA, 1413 nt, Artificial Sequence; identical to SEQ ID NO: 75394
  derived and/or modified sequence opt1 from neuraminidase__InfluenzaA__ACI32780

SEQ ID NO: 77556 - RNA, 1413 nt, Artificial Sequence; identical to SEQ ID NO: 75394
  derived and/or modified sequence opt1 from neuraminidase__InfluenzaA__ACI32781

SEQ ID NO: 77557 - RNA, 1413 nt, Artificial Sequence
  derived and/or modified sequence opt1 from neuraminidase__InfluenzaA__ACI32782
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacggggccgccuccuacaagaucuucaagaucgagaagggcaaggccaccaagagcaucgagcucaacgcgcccaacuuccacuacgaggagugcuccugcuacccggacaccgggaccgugaugugcgucugccgggacaacuggcacggcagcaaccgccccuggguguccuucaaccagaaccuggacuaccagaucggcuacaucugcagcgggguguucggcgacaacccccggcccaaggaccgcaagggguccugcaacccggucacgguggacggcgccgacggggugaagggcuucagcuacaaguacggcaacggggucuggaucggccggaccaaguccaaccgccugcggaagggguucgagaugaucugggaccccaacggcuggaccaacaccgacagcgacuucuccgugaagcaggacguggucgccaucacggacuggagcggguacagcggcuccuucgugcagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 77558 - RNA, 1413 nt, Artificial Sequence
  derived and/or modified sequence opt1 from neuraminidase__InfluenzaA__ACI32783
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccuggcuguccuucaaccagaaccuggacuaccagaucggcuacaucugcagcggcgucaucggggacaacccccggcccaaggacggcaagggguccugcaacccggugacgguggacggcgcggacggggucaagggcuucagcuacaaguacggcaacgggguguggaucggccgcaccaaguccaaccggcuccgcaagggguucgagaugaucugggaccccaacggcuggaccgacaccgacagcgacuucuccgugaagcaggacgucguggccaucacggacuggagcggguacagcggcuccuucgugcagcaccccgagcugaccggccuggacugcauccggcccugcuucugggucgagcucgugcgcgggcugccgcgggagaacaccaccaucuggacgagcggcuccagcaucuccuucugcggggucgacggcgacaccgccaacuggagcuggcccgacggcgccgagcugcccuucaccaucgacaaguga

SEQ ID NO: 77559 - RNA, 1413 nt, Artificial Sequence
  derived and/or modified sequence opt1 from neuraminidase__InfluenzaA__ACI32784
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacggggccgccuccuacaagaucuucaagaucgagaagggcaaggccaccaagagcaucgagcucaacgcgcccaacuuccacuacgaggagugcuccugcuacccggacaccgggaccgugaugugcgucugccgggacaacuggcacggcagcaaccgccccuggguguccuucaaccagaaccuggacuaccagaucggcuacaucugcagcgggguguucggcgacaacccccggcccaaggaccgcgagggguccugcaacccggucacgguggacggcgccgacggggugaagggcuucagcuacaaguacggcaacggggucuggaucggccggaccaaguccaaccgccugcggaagggguucgagaugaucugggaccccaacggcuggaccaacaccgacagcgacuucuccgugaagcaggacguggucgccaucacggacuggagcggguacagcggcuccuucgugcagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 77560 - RNA, 1413 nt, Artificial Sequence
  derived and/or modified sequence opt1 from neuraminidase__InfluenzaA__ACI32785
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaugugcaaccagcgcaucaucaccuacgagaacuccaccugggugaaccacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcgcauccugcggacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggguacaucugcagcggcguguucggcgacaacccccgccccaaggacgggaagggcuccugcaacccggugacggucgacggggcggacggcgugaagggguucagcuacaaguacggcaacggcguguggaucgggcggaccaaguccaaccgccugcggaagggcuucgagaugaucugggaccccaacgggugggccgacaccgacagcgacuucuccgucaagcaggacgugguggccaucaccgacuggagcggcuacagcggguccuucguccagcaccccgagcucacgggccugaacugcauccgccccugcuucuggguggagcugguccggggccucccgcgcgagaacaccaccaucuggaccagcggguccagcaucuccuucugcggcguggacagcgacacggccaacugguccuggcccgacggggccgagcugcccuucaccaucgacaaguga

SEQ ID NO: 77561 - RNA, 1413 nt, Artificial Sequence
  derived and/or modified sequence opt1 from neuraminidase__InfluenzaA__ACI32787
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagccgcuucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcagcugcuacccggacaccgggacggucaugugcgugugccgggacaacuggcacggcuccaaccgccccugggugagcuucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagagcaaccggcugcgcaagggcuucgagaugaucugggaccccaacggguggaccaacacggacuccgacuucagcgugaagcaggacgucguggccaucaccgacugguccggcuacagcgggagcuucgugcagcaccccgagcucaccggccuggacugcauccggcccugcuucugggucgagcuggugcgcggccucccgcgggagaacaccacgaucuggaccuccgggagcuccaucagcuucugcggcgucaacgggggcaccgccgacugguccuggcccgacggcgccgagcugcccuucaccaucgacaaguga

SEQ ID NO: 77562 - RNA, 1413 nt, Artificial Sequence
  derived and/or modified sequence opt1 from neuraminidase__InfluenzaA__ACI32788
augaaccccaaccagaagaucaucaccaucggcagcaucuccaucgccaucgggaucaucagccugaugcuccagaucggcaacaucaucuccaucugggccagccacuccauccagaccgggagccagaaccacacggggaccugcaaccagcgcaucaucaccuacgagaacaacaccugggugaaccacacgugcgucaacaucaacaacaccaacgugguggcgggcaaggacaagaccuccgucacccuggugggcaacagcucccugugcagcaucuccggcugggccaucuacacgaaggacaacagcauccggaucggguccaagggcgacguguucgucauccgcgagccguucaucagcugcucccaccucgagugccggaccuucuuccugacccagggggcccugcucaacgacaagcacagcaacggcaccgugaaggaccgcucccccuaccgggcccugaugagcugcccccugggggaggcccccuccccguacaacagcaaguucgagagcguggcgugguccgccagcgccugccacgacggcaagggcuggcucacgaucgggaucuccggccccgacaacggggccgucgcggugcugaaguacaacggcaucaucaccgagaccaucaagagcuggaagaagcgcauccugcggacccaggaguccgagugcgugugcgucaacggcagcugcuucacgaucaugaccgacgggcccuccaacggcgccgccagcuacaagaucuucaagaucgagaaggggaaggugaccaaguccaucgagcucaacgcccccaacuuccacuacgaggagugcagcugcuacccggacaccggcacggugaugugcgucugccgcgacaacuggcacggguccaaccggcccugggugagcuucaaccagaaccuggacuaccagaucggcuacaucugcuccggcguguucggggacaacccccgccccaaggacggcaaggggagcugcaacccgaugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacugguccggguacagcggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 77563 - RNA, 1410 nt, Artificial Sequence
  derived and/or modified sequence opt1 from neuraminidase__InfluenzaA__ACI32790
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaaccaggagaccgaggugcucuggaccagcaacuccaucgucguguucugcggcaccagcgggacguacggcaccggguccuggccggacggcgccgacaucaaccugaugcccaucuga

SEQ ID NO: 77564 - RNA, 1410 nt, Artificial Sequence; identical to SEQ ID NO: 75390
  derived and/or modified sequence opt1 from neuraminidase__InfluenzaA__ACI32791

SEQ ID NO: 77565 - RNA, 1410 nt, Artificial Sequence; identical to SEQ ID NO: 75390
  derived and/or modified sequence opt1 from neuraminidase__InfluenzaA__ACI32793

SEQ ID NO: 77566 - RNA, 1410 nt, Artificial Sequence; identical to SEQ ID NO: 75390
  derived and/or modified sequence opt1 from neuraminidase__InfluenzaA__ACI32794

SEQ ID NO: 77567 - RNA, 1410 nt, Artificial Sequence; identical to SEQ ID NO: 75720
  derived and/or modified sequence opt1 from neuraminidase__InfluenzaA__ACI32795

SEQ ID NO: 77568 - RNA, 1410 nt, Artificial Sequence
  derived and/or modified sequence opt1 from neuraminidase__InfluenzaA__ACI32796
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcuccaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagucccgcagcggcuacgagaccuucaaggucaucgagggguggagcaaccccaacuccaagcugcagaucaaccgccaggugaucguggaccggggcaaccggagcggguacagcggcaucuucuccgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 77569 - RNA, 1410 nt, Artificial Sequence
  derived and/or modified sequence opt1 from neuraminidase__InfluenzaA__ACI32797
augaaccccaaccagaugaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcuccaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagucccgcagcggcuacgagaccuucaaggucaucgagggguggagcaaccccaacuccaagcugcagaucaaccgccaggugaucguggaccggggcaaccggagcggguacagcggcaucuucuccgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 77570 - RNA, 1410 nt, Artificial Sequence
  derived and/or modified sequence opt1 from neuraminidase__InfluenzaA__ACI32798
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaacgagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77571 - RNA, 1410 nt, Artificial Sequence
  derived and/or modified sequence opt1 from neuraminidase__InfluenzaA__ACI32799
augaaccccaaccagcgcaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccaacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaagaacuacuccaucgugagcuccuacgugugcagcggccuggucggcgacacgccccggaagaccgacuccagcuccagcucccacugccucgaccccaacaacgaggagggcgggcacggggugaagggcugggccuucgacgacgggaacgacgucuggaugggccgcaccaucagcgagaagcugcggcugggcuacgagaccuucaaggugaucgaggggugguccaaccccaacagcaagcuccagaucaaccgccaggugaucgucgaccggggcaaccgcuccggguacagcggcaucuucuccguggagggcaagagcugcaucaaccggugcuucuacguggagcugauccgcgggcggaaggaggagaccgagguccuguggaccagcaacuccaucgugguguucugcggcacgagcgggaccuacggcaccggguccuggccggacggcgccgacaucaaccucaugcccaucuga

SEQ ID NO: 77572 - RNA, 1410 nt, Artificial Sequence
  derived and/or modified sequence opt1 from neuraminidase__InfluenzaA__ACI32800
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 77573 - RNA, 1410 nt, Artificial Sequence; identical to SEQ ID NO: 77572
  derived and/or modified sequence opt1 from neuraminidase__InfluenzaA__ACI32802

SEQ ID NO: 77574 - RNA, 1410 nt, Artificial Sequence; identical to SEQ ID NO: 77572
  derived and/or modified sequence opt1 from neuraminidase__InfluenzaA__ACI32803

SEQ ID NO: 77575 - RNA, 1410 nt, Artificial Sequence; identical to SEQ ID NO: 76715
  derived and/or modified sequence opt1 from neuraminidase__InfluenzaA__ACI32804

SEQ ID NO: 77576 - RNA, 1410 nt, Artificial Sequence
  derived and/or modified sequence opt1 from neuraminidase__InfluenzaA__ACI32805
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgugaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgaccgguccagcuccagccacugccucgaccccaacaacgaggagggcgggcacggggugaagggcugggccuucgacgacgggaacgacgucuggaugggccgcaccaucuccgagaagucccggagcggcuacgagaccuucaaggugaucgagggguggagcaaccccaacuccaagcugcagaccaaccgccaggugaucgucgaccggggcaaccgcagcggguacuccggcaucuucagcguggagggcaagagcugcaucaaccggugcuucuacguggagcugauccgcgggcggaaggaggagaccgagguccucuggaccuccaacagcaucgugguguucugcggcacguccgggaccuacggcaccgggagcuggccggacggcgccgacaucaaccugaugcccaucuga

SEQ ID NO: 77577 - RNA, 1410 nt, Artificial Sequence; identical to SEQ ID NO: 75720
  derived and/or modified sequence opt1 from neuraminidase__InfluenzaA__ACI32806

SEQ ID NO: 77578 - RNA, 1410 nt, Artificial Sequence
  derived and/or modified sequence opt1 from neuraminidase__InfluenzaA__ACI32807
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77579 - RNA, 1410 nt, Artificial Sequence
  derived and/or modified sequence opt1 from neuraminidase__InfluenzaA__ACI32808
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggagaagaccgagguccuguggaccagcaacuccaucgugguguucugcggcacgagcgggaccuacggcaccggguccuggccggacggcgccgacaucaaccucaugcccaucuga

SEQ ID NO: 77580 - RNA, 1410 nt, Artificial Sequence; identical to SEQ ID NO: 76715
  derived and/or modified sequence opt1 from neuraminidase__InfluenzaA__ACI32809

SEQ ID NO: 77581 - RNA, 1410 nt, Artificial Sequence
  derived and/or modified sequence opt1 from neuraminidase__InfluenzaA__ACI32810
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccgcaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 77582 - RNA, 1410 nt, Artificial Sequence
  derived and/or modified sequence opt1 from neuraminidase__InfluenzaA__ACI32811
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77583 - RNA, 1410 nt, Artificial Sequence
  derived and/or modified sequence opt1 from neuraminidase__InfluenzaA__ACI32812
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccaacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 77584 - RNA, 1410 nt, Artificial Sequence; identical to SEQ ID NO: 75807
  derived and/or modified sequence opt1 from neuraminidase__InfluenzaA__ACI32814

SEQ ID NO: 77585 - RNA, 1350 nt, Artificial Sequence
  derived and/or modified sequence opt1 from neuraminidase__InfluenzaA__ACJ53848
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaccgggaccgacagcuccuucagcgugaagcaggacaucgucgccaucacggacugguccggcuacagcggguccuucgugcagcaccccgagcugaccggccucgacugcauccgccccugcuucugggucgagcugauccggggccgccccaaggagagcaccaucuggaccuccgggagcuccaucagcuucugcggcgugaacuccgacacggugagcugguccuggccggacggggccgagcugcccuucaccaucgacaaguga

SEQ ID NO: 77586 - RNA, 1350 nt, Artificial Sequence
  derived and/or modified sequence opt1 from neuraminidase__InfluenzaA__ACJ53849
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcagccccgugucccccaacggggcguacggcgucaagggguucagcuucaaguacggcaacgggguguggaucggccgcaccaaguccaccaacagccggagcggcuucgagaugaucugggacccgaacggguggaccggcaccgacuccagcuucuccgugaagcaggacaucgucgccaucacggacuggagcggguacuccggcagcuucgugcagcaccccgagcugaccgggcucgacugcauccgccccugcuucugggucgagcugauccggggccgccccaaggaguccaccaucuggaccagcggcuccagcaucuccuucugcggggugaacagcgacacgguguccuggagcuggccggacggcgccgagcugcccuucaccaucgacaaguga

SEQ ID NO: 77587 - RNA, 1350 nt, Artificial Sequence
  derived and/or modified sequence opt1 from neuraminidase__InfluenzaA__ACJ53853
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacauccugcgcacccaggaguccgagugcgcgugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccguguuccccaacggcgccuacggggucaagggcuucagcuucaaguacgggaacggcguguggaucggccgcaccaaguccaccaacagccgguccggguucgagaugaucugggacccgaacggcuggaccgggaccgacagcagcuucuccgugaagcaggacaucgucgcgaucacggacuggagcggcuacuccgggagcuucgugcagcaccccgagcugaccggccucgacugcauccgccccugcuucugggucgagcugauccggggccgccccaaggaguccaccaucuggaccagcggguccagcaucuccuucugcggcgugaacagcgacacgguguccuggagcuggccggacggggccgagcugcccuucaccaucgacaaguga

SEQ ID NO: 77588 - RNA, 1350 nt, Artificial Sequence; identical to SEQ ID NO: 77587
  derived and/or modified sequence opt1 from neuraminidase__InfluenzaA__ACJ53866

SEQ ID NO: 77589 - RNA, 1350 nt, Artificial Sequence
  derived and/or modified sequence opt1 from neuraminidase__InfluenzaA__ACJ53867
augaaccccaaccagaagaucaucaccaucggcagcaucugcauggccaucgggaucgugucccugaugcuccagaucggcaacaugaucagccugugggucucccacagcauccagaccgggaaccagugccaggccgagccgaucuccaacacgaaguuccugaccgagaaggcgguggccagcgugacccucgccggcaacuccagccugugccccaucuccgggugggccgucuacagcaaggacaacuccauccgcaucggcagccggggcgacguguucgugauccgcgagcccuucaucuccugcagccaccuggagugccggaccuucuuccucacgcagggggcccugcugaacgacaagcacuccaacggcaccgucaaggaccgcagcccccaccggacccucauguccugcccggugggggaggcgcccagccccuacaacucccgcuucgagagcguggccuggagcgccuccgccugccacgacggcaccagcuggcugacgaucgggaucuccggccccgacaacggcgcggucgccgugcugaaguacaacgggaucaucaccgacaccaucaagagcuggcggaacaacauccuccgcacccaggaguccgagugcgccugcgugaacggcagcugcuucacggucaugaccgacgggccguccagcggccaggccuccuacaagaucuucaagauggagaagggcaagguggucaagagcguggagcuggacgcccccaacuaccacuacgaggagugcuccugcuaccccgacgcgggggagaucacgugcgugugccgggacaacuggcacggcagcaaccgccccuggguguccuucaaccagaaccuggaguaccagaucggguacaucugcagcggcgucuucggggacaacccgcggcccaacgacggcaccggcuccugcgggcccgugagccccaacggcgccuacggggugaagggcuucuccuucaaguacgggaacggcgucuggaucggccgcaccaagagcaccaacucccggagcggguucgagaugaucugggacccgaacggcuggaccgggaccgacagcuccuucagcgugaagcaggacaucguggccaucacggacugguccggcuacagcggguccuucguccagcaccccgagcucaccggccuggacugcauccgccccugcuucuggguggagcugauccggggccgccccaaggagagcaccaucuggaccuccgggagcuccaucagcuucugcggcgucaacuccgacacggugagcugguccuggccggacggggccgagcuccccuucaccaucgacaaguga

SEQ ID NO: 77590 - RNA, 1350 nt, Artificial Sequence
  derived and/or modified sequence opt1 from neuraminidase__InfluenzaA__ACJ53875
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaucagcuggcucaccaucgggaucuccggccccgacaacggcgccguggcggugcugaaguacaacgggaucaucacggacaccaucaagagcuggcggaacaacauccugcgcacccaggaguccgagugcgccugcgucaacggcagcugcuucaccgugaugacggacgggccguccagcggccaggccuccuacaagaucuucaagauggagaagggcaagguggucaagagcguggagcucgaggcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaccgggaccgacagcuccuucagcgugaagcaggacaucgucgccaucaccgacugguccggcuacagcggguccuucgugcagcaccccgagcugacgggccucgacugcauccgccccugcuucugggucgagcugauccggggccgccccaaggagagcaccaucuggaccuccgggagcuccaucagcuucugcggcgugaacuccgacaccgugagcugguccuggccggacggggccgagcugcccuucacgaucgacaaguga

SEQ ID NO: 77591 - RNA, 1350 nt, Artificial Sequence
  derived and/or modified sequence opt1 from neuraminidase__InfluenzaA__ACJ53876
augaaccccaaccagaagaucaucaccaucggcagcaucugcauggugaucgggaucgucucccugaugcuccagaucggcaacaucaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaccgggaccgacagcuccuucagcgugaagcaggacaucgucgccaucacggacugguccggcuacagcggguccuucgugcagcaccccgagcugaccggccucgacugcauccgccccugcuucugggucgagcugauccggggccgccccaaggagagcaccaucuggaccuccgggagcuccaucagcuucugcggcgugaacuccgacacggugggguggagcuggccggacggcgccgagcugcccuucaccaucgacaaguga

SEQ ID NO: 77592 - RNA, 1404 nt, Artificial Sequence
  derived and/or modified sequence opt1 from neuraminidase__InfluenzaA__ACJ67535
augaaccccaaccagaagaucaucgcccugggcagcguguccaucaccaucgccaccaucugccucaucaugcagaucgcgguccuggccacgaccaugacccugcacuucaacgagugcaccaacccgagcaacaaccaggccaugcccugcgagcccaucaucaucgagcgcaacaugacggagaucgugcaccucaacaacaccaccaucgagaaggaguccugccccaagguggccgaguacaagaacuggagcaagccgcagugccagaucaccggguucgcccccuucuccaaggacaacagcauccggcuguccgcgggcggggacaucugggucacgcgcgagcccuacgugagcugcggccuggggaacugcuaccaguucgcccucggccagggcaccacccugaacaacaagcacuccaacgacaccauccacgaccggagcccccaccgcacgcugcucaugaacgagcugggggugccguuccaccugggcaccaagcaggucugcaucgccugguccagcuccagcugccacgacgggaaggccuggcuccacgugugcgugaccggcgacgaccggaacgcgaccgccuccaucaucuacgacgggaugcugacggacagcaucggcuccuggagcaagaacauccugcgcacccaggaguccgagugcgucugcaucaacgggaccugcaccguggugaugacggacgggagcgccagcggccgggccgacaccaagauccucuucauccgcgaggggaagaucguccacaucagcccccuguccggcuccgcccagcacguggaggagugcagcugcuacccccgguaccccgaggugcgcugcgucugccgggacaacuggaagggcuccaaccgcccggugcuguacaucaacguggcggacuacagcgucgacuccagcuacgugugcuccgggcucgugggcgacacgccccggaacgacgacagcuccagcuccagcaacugccgcgaccccaacaacgagcggggcggccccggggucaagggcugggccuucgacaacggcaacgacguguggauggggcgcaccaucaagaaggacucccggagcggcuacgagaccuuccgcguggucgggggcuggaccaccgccaacuccaagagccagaucaaccgccaggugaucgucgacuccgacaacuggagcggguacagcggcaucuucuccguggagggcaagaccugcaucaaccggugcuucuacguggagcugauccgggggcgcccgcaggagacgcgcgucugguggaccagcaacuccaucaucguguucugcggcaccagcgggaccuacggcacgggguccuggcccgacggcgccaacaucaacuucaugagcaucuga

SEQ ID NO: 77593 - RNA, 1410 nt, Artificial Sequence
  derived and/or modified sequence opt1 from neuraminidase__InfluenzaA__ACK99424
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugauccccugccagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccguccaagugcuaccaguucgcccucggccaggggaccacgcugaacaaccgccacagcaacgacaccgugcacgaccggacccccuaccgcacccugcucaugaacgagcugggcgugcccuuccaccugggcacgaagcaggucugcaucgccugguccagcuccagcugccacgacgggaaggccuggcuccacgugugcgugaccggccacgacgagaacgcgaccgccuccuucaucuacgacgggcggcuggucgacagcaucggcuccuggagcaagaacauccugcgcacccaggaguccgagugcgugugcaucaacgggacgugcaccguggucaugaccgacggcagcgccagcgagcgggccgacaccaagauccucuucaucgaggagggcaagguggugcacaucagcccccuguccggguccgcgcagcacgucgaggagugcagcugcuacccgcgcuaccccggcgugcggugcgugugccgcgacaacuggaagggguccaaccggcccaucgucgacaucaacgugaaggacuacagcaucguguccagcuacgucugcuccggccuggugggcgacacgccccgcaagaacgacagcuccagcuccagcuacugccggaacccgaacaacgagaaggggucccacggcgucaaggggugggccuucgacgacggcaacgacguguggauggggcgcaccaucagcgaggagcuccgguccggcuacgagaccuucaaggugaucggcggguggagcacccccaacuccaagcugcagaucaaccgccaggucaucguggacagcggcaaccggagcggguacuccggcaucuucagcguggaggggaaguccugcaucaaccgcugcuucuacgucgagcugauccggggccgcaagcaggagacgaaggugugguggaccagcaacuccaucguggucuucugcggcaccagcgggaccuacggcacgggguccuggcccgacggcgccgacaucaaccucaugcccaucuga

SEQ ID NO: 77594 - RNA, 1410 nt, Artificial Sequence; identical to SEQ ID NO: 77413
  derived and/or modified sequence opt1 from neuraminidase__InfluenzaA__ACK99435

SEQ ID NO: 77595 - RNA, 1413 nt, Artificial Sequence
  derived and/or modified sequence opt1 from neuraminidase__InfluenzaA__ACK99446
augaaccccaaccagaagaucaucaccaucggcagcaucuccauggccaucgggaucaucagccugacccuccagaucggcaacaucaucuccaucugggugagccacuccauccagacggggagccagaaccacaccggcaucugcaaccagcgcaucaucaccuacgagaacuccaccugggucaaccagacguacgugaacaucaacaacaccaacguggucgccgggaaggacaagaccagcgugacccuggcgggcaacuccagccugugcccgauccggggcugggccaucuacacgaaggacaacuccauccgcaucgggagcaagggcgacguguucgucauccgggagcccuucaucuccugcagccaccucgagugccgcaccuucuuccugacccagggggcccugcucaacgacaagcacuccaacggcaccgugaaggaccggagcccccaccgcgcccugauguccugcccccugggggaggccccgagccccuacaacucccgguucgagagcguggcguggagcgccuccgccugccacgacggcaugggcuggcucacgaucgggaucagcggccccgacgacggggccgucgcggugcugaaguacaacggcaucaucaccgagaccaucaaguccuggaagaagcgcauccugcggacccaggagagcgagugcgugugcgucaacggcuccugcuucacgaucaugaccgacgggcccagcaacggcgccgccuccuaccgcaucuucaagaucgagaaggggaaggugaccaagagcaucgagcucgacgccccgaacucccacuacgaggagugcagcugcuaccccgacaccggcacggugaugugcgucugccgggacaacuggcacggguccaaccgccccugggugagcuucaaccagaaccuggacuaccagaucggcuacaucugcuccggcguguucggggacaacccccggccgaaggacggcaaggggagcugcaaccccgucaccguggacggcgccgacggggugaagggcuucuccuaccgcuacggcaacggggucuggaucggccggaccaagagcaaccgcuuccggaagggguucgagaugaucugggaccccaacggcuggaccgacacggacuccgacuucagcgugaagcaggacguggucgcgaugaccgacugguccggguacagcggcagcuucgugcagcaccccgagcugaccggccucgacugcaugcgcccgugcuucugggucgagcuggugcgggggcgcccccgggagaacaccacgaucuggaccuccggcagcuccaucagcuucugcggggugaacuccgacaccgccaacuggagcuggcccgacggcgccgagcugcccuucaccaucgacaaguga

SEQ ID NO: 77596 - RNA, 1410 nt, Artificial Sequence
  derived and/or modified sequence opt1 from neuraminidase__InfluenzaA__ACK99457
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucguguccuggagcaagaacauccugcgcacccaggaguccgagugcgugugcaucaacgggacgugcaccgucgugaugaccgacggcagcgccuccgagcgggccgacaccaagauccucuucaucgaggagggcaagaucgugcacaucagcccccugagcggguccgcgcagcacgucgaggagugcagcugcuacccgcgcuaccccggcgugcggugcgugugccgcgacaacuggaagggguccaaccggcccaucgucgacaucaacgugaaggacuacagcaucguguccagcuacgucugcuccggccuggugggcgacacgccccgcaagaacgacagcuccagcuccagcuacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacagcaagcugcagacgaaccgccaggucaucguggaccgggggaaccgcuccggcuacagcgggaucuucuccguggagggcaagagcugcaucaaccggugcuucuacgucgagcugauccgcggccgcaagcaggagaccaaggugugguggaccagcaacuccaucguggucuucugcgggaccagcggcacguacgggaccggcuccuggcccgacggggccgacaucaaccucaugcccaucuga

SEQ ID NO: 77597 - RNA, 1413 nt, Artificial Sequence
  derived and/or modified sequence opt1 from neuraminidase__InfluenzaA__ACK99468
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccagccugugcccgauccggggcugggccaucuacaccaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugcccccugggggaggcgccgagccccuacaacucccgguucgagagcgucgccuggagcgccuccgccugccacgacggccucggcuggcugaccaucgggaucagcggccccgacaacggggcgguggccgugcugaaguacaacggcaucaucacggagaccaucaaguccuggaagaagcgcauccuccggacccaggagagcgagugcgucugcaugaacuccagcugcuucaccaucaugacggacggccccuccaacggggccgccagcuaccgcaucuucaagaucgagaagggccgggugaccaaguccaucgagcuggacgccccgaacuaccacuacgaggagugcagcugcuaccccgacaccgggaccgugaugugcgucugccgcgacaacuggcacggcuccaaccggcccugggugagcuucaaccagaaccuggacuaccagaucggguacaucugcuccggcguguucggcgacaacccccgcccgaaggacggggagggcagcugcaaccccgucacgguggacggggcggacggcgugaagggguucuccuaccgguacggcaacggcgucuggaucgggcgcaccaagagcaaccggcuccgcaagggcuucgagaugaucugggaccccaacggguggaccgacaccgacuccgacuucagcaugaagcaggacaucguggccaugacggacugguccggcuacagcgggagcuucgugcagcaccccgagcugaccggccuggacugcaugcggccgugcuucugggucgagcucgugcgcggccugccccgggagaacaccaccaucuggacguccgggagcuccaucagcuucugcggcgugaacuccgacaccgccaacuggagcuggcccgacggggccgagcugcccuucaccaucgacaaguga

SEQ ID NO: 77598 - RNA, 1410 nt, Artificial Sequence
  derived and/or modified sequence opt1 from neuraminidase__InfluenzaA__ACK99479
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugcucggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcuccgcuccggguacgagaccuucaaggucaucgagggcuggagcaagccgaacuccaagcugcagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggggccaacaucaaccucaugcccaucuga

SEQ ID NO: 77599 - RNA, 1413 nt, Artificial Sequence; identical to SEQ ID NO: 77292
  derived and/or modified sequence opt1 from neuraminidase__InfluenzaA__ACL12066

SEQ ID NO: 77600 - RNA, 1410 nt, Artificial Sequence; identical to SEQ ID NO: 76193
  derived and/or modified sequence opt1 from neuraminidase__InfluenzaA__ACL12132

SEQ ID NO: 77601 - RNA, 1413 nt, Artificial Sequence; identical to SEQ ID NO: 77526
  derived and/or modified sequence opt1 from neuraminidase__InfluenzaA__ACL12154

SEQ ID NO: 77602 - RNA, 1410 nt, Artificial Sequence; identical to SEQ ID NO: 77520
  derived and/or modified sequence opt1 from neuraminidase__InfluenzaA__ACL12165

SEQ ID NO: 77603 - RNA, 1410 nt, Artificial Sequence; identical to SEQ ID NO: 77520
  derived and/or modified sequence opt1 from neuraminidase__InfluenzaA__ACL12176

SEQ ID NO: 77604 - RNA, 1410 nt, Artificial Sequence
  derived and/or modified sequence opt1 from neuraminidase__InfluenzaA__ACL12198
augaaccccaaccagaagaucaucaccaucggcagcgugucccugaccaucagcacgaucugcuucuucaugcagaucgccauccucaucaccaccgucacccugcacuucaagcaguacgaguucaacuccacgccgaacaaccaggugaugcugugcgagcccaccaucaucgagcgcaacaucaccgagaucguguaccucaccaacacgaccaucgagaaggagaucugccccaagcuggccgaguaccggaacuggagcaagccccagugcgacaucaccggguucgcgccguucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggacccccuaccgcacgcugcucaugaacgagcugggcgugccguuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccucgaccccaacaacgaggagggcggccacggggucaagggcugggccuucgacgacgggaacgacguguggaugggccgcacgaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggcccgacggcgccgacaucaaccugaugccgaucuga

SEQ ID NO: 77605 - RNA, 1410 nt, Artificial Sequence; identical to SEQ ID NO: 77098
  derived and/or modified sequence opt1 from neuraminidase__InfluenzaA__ACL12209

SEQ ID NO: 77606 - RNA, 1410 nt, Artificial Sequence; identical to SEQ ID NO: 77520
  derived and/or modified sequence opt1 from neuraminidase__InfluenzaA__ACL12220

SEQ ID NO: 77607 - RNA, 1410 nt, Artificial Sequence
  derived and/or modified sequence opt1 from neuraminidase__InfluenzaA__ACL12242
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77608 - RNA, 1413 nt, Artificial Sequence
  derived and/or modified sequence opt1 from neuraminidase__InfluenzaA__ACL12264
augaaccccaaccagaagaucaucaccaucggcagcaucuccauggccaucgggaucaucagccugauccuccagaucgugaacaucaucuccaucugggucagccacuccauccagaccggcagccagaaccacacggggaucugcaaccagcgcaucaucaccuacgagaacuccaccugggugaaccagaccuacgugaacaucaacaacacgaacgucguggccggcaaggacaagaccagcgugacccuggcggggaacuccagccugugcccgauccggggcugggccaucuacaccaaggacaacuccauccgcaucggcagcaagggggacgucuucgugauccgggagcccuucaucuccugcagccaccucgagugccgcacguucuuccugacccagggcgcccugcucaacgacaagcacuccaacgggaccgugaaggaccggagccccuaccgcgcccugauguccugcccccugggcgaggccccgagccccuacaacucccgguucgagagcgucgcguggagcgccuccgccugccacgacgggaugggcuggcucaccaucggcaucagcgggcccgacgacggcgccguggcggugcugaaguacaacgggaucaucacggagaccaucaaguccuggaagaagcgcauccugcggacccaggagagcgagugcgucugcgugaacggcuccugcuucaccaucaugacggacggccccagcaacggggccgccuccuaccgcaucuucaagaucgagaagggcaaggugaccaagagcaucgagcucgacgccccgaacucccacuacgaggagugcagcugcuaccccgacaccgggaccgucaugugcgugugccgggacaacuggcacggcuccaaccgccccugggugagcuucaaccagaaccuggacuaccagaucggguacaucugcuccggcgucuucggcgacaacccccggccgaaggacgggaagggcagcugcgaccccgugacgguggacggggccgacggcgucaagggguucuccuaccgcuacggcaacggcguguggaucgggcggaccaagagcaaccgcuuccggaagggcuucgagaugaucugggaccccaacggguggaccgacaccgacuccgacuucagcgugaagcaggacgucguggcgaugacggacugguccggcuacagcgggagcuucguccagcaccccgagcugaccggccucgacugcaugcgcccgugcuucuggguggagcuggugcggggccgcccccgggagaacaccaccaucuggacguccgggagcuccaucagcuucugcggcgucaacuccgacaccgccaacuggagcuggcccgacggggccgagcugcccuucaccaucgacaaguga

SEQ ID NO: 77609 - RNA, 1410 nt, Artificial Sequence; identical to SEQ ID NO: 77413
  derived and/or modified sequence opt1 from neuraminidase__InfluenzaA__ACN32275

SEQ ID NO: 77610 - RNA, 1410 nt, Artificial Sequence
  derived and/or modified sequence opt1 from neuraminidase__InfluenzaA__ACN32286
augaaccccaacaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccugcugggguccgcgcagcacguggaggagugcagcugcuacccccgguaccccggcgugcgcugcgucugccgggacaacuggaagggguccaaccgcccgaucguggacaucaacaucaaggaccacagcaucguguccagcuacgucugcuccggccucgugggcgacacgccccggaagaacgacagcuccagcuccgggcacugccuggaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcuccagaucaaccgccaggucaucguggaccgggggaaccgcagcggcuacuccgggaucuucagcguggagggcaaguccugcaucaaccggugcuucuacgucgagcugauccgcggccggaaggaggagaccgaggugcuguggaccagcaacagcaucguggucuucugcgggaccuccggcacguacgggaccggcagcuggccggacggggccgacaucaaccucaugcccaucuga

SEQ ID NO: 77611 - RNA, 1410 nt, Artificial Sequence
  derived and/or modified sequence opt1 from neuraminidase__InfluenzaA__ACN32493
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaaggagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 77612 - RNA, 1410 nt, Artificial Sequence; identical to SEQ ID NO: 75162
  derived and/or modified sequence opt1 from neuraminidase__InfluenzaA__ACN32526

SEQ ID NO: 77613 - RNA, 1410 nt, Artificial Sequence
  derived and/or modified sequence opt1 from neuraminidase__InfluenzaA__ACN32537
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccgacgugcgcugcgucugccgggacaacuggaagggcuccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaaggggugggccuucgacgacggcaacgacguguggaugggccgcaccaucagcgagaagcugcgguccggguacgagaccuucaaggucaucgacggcuggagcaagcccaacuccaagcuccagaucaaccgccaggugaucguggagcgggggaaccgcagcggcuacuccgggaucuucagcgucgagggcaaguccugcaucaaccggugcuucuacguggagcugauccgcggccggaaggaggagaccgaggugugguggaccagcaacagcaucgucguguucugcgggaccuccggcaccuacgggacgggcagcuggccggacggggccgacaucaaccugaugcccaucuga

SEQ ID NO: 77614 - RNA, 1413 nt, Artificial Sequence; identical to SEQ ID NO: 77090
  derived and/or modified sequence opt1 from neuraminidase__InfluenzaA__ACN32807

SEQ ID NO: 77615 - RNA, 1413 nt, Artificial Sequence; identical to SEQ ID NO: 77038
  derived and/or modified sequence opt1 from neuraminidase__InfluenzaA__ACN32818

SEQ ID NO: 77616 - RNA, 1413 nt, Artificial Sequence; identical to SEQ ID NO: 77038
  derived and/or modified sequence opt1 from neuraminidase__InfluenzaA__ACN32829

SEQ ID NO: 77617 - RNA, 1413 nt, Artificial Sequence
  derived and/or modified sequence opt1 from neuraminidase__InfluenzaA__ACN32840
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgugaacuggagcuggcccgacggcgccgagcugcccuucaccaucgacaaguga

SEQ ID NO: 77618 - RNA, 1410 nt, Artificial Sequence; identical to SEQ ID NO: 77520
  derived and/or modified sequence opt1 from neuraminidase__InfluenzaA__ACN32851

SEQ ID NO: 77619 - RNA, 1410 nt, Artificial Sequence; identical to SEQ ID NO: 77607
  derived and/or modified sequence opt1 from neuraminidase__InfluenzaA__ACN32862

SEQ ID NO: 77620 - RNA, 1410 nt, Artificial Sequence; identical to SEQ ID NO: 77611
  derived and/or modified sequence opt1 from neuraminidase__InfluenzaA__ACN32873

SEQ ID NO: 77621 - RNA, 1410 nt, Artificial Sequence; identical to SEQ ID NO: 77607
  derived and/or modified sequence opt1 from neuraminidase__InfluenzaA__ACN32884

SEQ ID NO: 77622 - RNA, 1410 nt, Artificial Sequence; identical to SEQ ID NO: 77611
  derived and/or modified sequence opt1 from neuraminidase__InfluenzaA__ACN32895

SEQ ID NO: 77623 - RNA, 1410 nt, Artificial Sequence; identical to SEQ ID NO: 77520
  derived and/or modified sequence opt1 from neuraminidase__InfluenzaA__ACN32906

SEQ ID NO: 77624 - RNA, 1410 nt, Artificial Sequence
  derived and/or modified sequence opt1 from neuraminidase__InfluenzaA__ACN32917
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcaagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaccgaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 77625 - RNA, 1410 nt, Artificial Sequence
  derived and/or modified sequence opt1 from neuraminidase__InfluenzaA__ACN32928
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaccgaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 77626 - RNA, 1410 nt, Artificial Sequence; identical to SEQ ID NO: 77611
  derived and/or modified sequence opt1 from neuraminidase__InfluenzaA__ACN32939

SEQ ID NO: 77627 - RNA, 1410 nt, Artificial Sequence; identical to SEQ ID NO: 77520
  derived and/or modified sequence opt1 from neuraminidase__InfluenzaA__ACN32950

SEQ ID NO: 77628 - RNA, 1410 nt, Artificial Sequence
  derived and/or modified sequence opt1 from neuraminidase__InfluenzaA__ACN32961
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaccgaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaacaucaugcccaucuga

SEQ ID NO: 77629 - RNA, 1410 nt, Artificial Sequence; identical to SEQ ID NO: 77607
  derived and/or modified sequence opt1 from neuraminidase__InfluenzaA__ACN32972

SEQ ID NO: 77630 - RNA, 1410 nt, Artificial Sequence; identical to SEQ ID NO: 77607
  derived and/or modified sequence opt1 from neuraminidase__InfluenzaA__ACN32994

SEQ ID NO: 77631 - RNA, 1410 nt, Artificial Sequence
  derived and/or modified sequence opt1 from neuraminidase__InfluenzaA__ACN33005
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggggagagcugcaucaaccggugcuucuacguggagcucauccgcggccggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77632 - RNA, 1410 nt, Artificial Sequence; identical to SEQ ID NO: 77607
  derived and/or modified sequence opt1 from neuraminidase__InfluenzaA__ACN33016

SEQ ID NO: 77633 - RNA, 1410 nt, Artificial Sequence; identical to SEQ ID NO: 77607
  derived and/or modified sequence opt1 from neuraminidase__InfluenzaA__ACN33049

SEQ ID NO: 77634 - RNA, 1410 nt, Artificial Sequence; identical to SEQ ID NO: 77607
  derived and/or modified sequence opt1 from neuraminidase__InfluenzaA__ACN33060

SEQ ID NO: 77635 - RNA, 1410 nt, Artificial Sequence; identical to SEQ ID NO: 77611
  derived and/or modified sequence opt1 from neuraminidase__InfluenzaA__ACN33082

SEQ ID NO: 77636 - RNA, 1413 nt, Artificial Sequence; identical to SEQ ID NO: 77077
  derived and/or modified sequence opt1 from neuraminidase__InfluenzaA__ACN33093

SEQ ID NO: 77637 - RNA, 1413 nt, Artificial Sequence; identical to SEQ ID NO: 77038
  derived and/or modified sequence opt1 from neuraminidase__InfluenzaA__ACN33104

SEQ ID NO: 77638 - RNA, 1410 nt, Artificial Sequence; identical to SEQ ID NO: 77611
  derived and/or modified sequence opt1 from neuraminidase__InfluenzaA__ACN33115

SEQ ID NO: 77639 - RNA, 1413 nt, Artificial Sequence
  derived and/or modified sequence opt1 from neuraminidase__InfluenzaA__ACN33126
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcuccagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacuggagcggcuacuccgggagcuucgugcagcaccccgagcucacgggccuggacugcauccggcccugcuucugggucgagcuggugcgcggccucccgcgggagaacaccaccaucuggaccuccgggagcuccaucagcuucugcggcgucaacuccgacacggccaacuggagcuggcccgacggggccgagcugcccuucaccaucgacaaguga

SEQ ID NO: 77640 - RNA, 1413 nt, Artificial Sequence
  derived and/or modified sequence opt1 from neuraminidase__InfluenzaA__ACN33148
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 77641 - RNA, 1410 nt, Artificial Sequence
  derived and/or modified sequence opt1 from neuraminidase__InfluenzaA__ACN33159
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77642 - RNA, 1410 nt, Artificial Sequence; identical to SEQ ID NO: 77520
  derived and/or modified sequence opt1 from neuraminidase__InfluenzaA__ACN33170

SEQ ID NO: 77643 - RNA, 1410 nt, Artificial Sequence; identical to SEQ ID NO: 77611
  derived and/or modified sequence opt1 from neuraminidase__InfluenzaA__ACN33181

SEQ ID NO: 77644 - RNA, 1410 nt, Artificial Sequence; identical to SEQ ID NO: 77611
  derived and/or modified sequence opt1 from neuraminidase__InfluenzaA__ACN33203

SEQ ID NO: 77645 - RNA, 1410 nt, Artificial Sequence
  derived and/or modified sequence opt1 from neuraminidase__InfluenzaA__ACN33214
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaccguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 77646 - RNA, 1413 nt, Artificial Sequence; identical to SEQ ID NO: 77079
  derived and/or modified sequence opt1 from neuraminidase__InfluenzaA__ACN42984

SEQ ID NO: 77647 - RNA, 1413 nt, Artificial Sequence; identical to SEQ ID NO: 77079
  derived and/or modified sequence opt1 from neuraminidase__InfluenzaA__ACN42995

SEQ ID NO: 77648 - RNA, 1410 nt, Artificial Sequence
  derived and/or modified sequence opt1 from neuraminidase__InfluenzaA__ACN43006
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccgcgugaugcugugcgagcccacgaucaucgagcggaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77649 - RNA, 1410 nt, Artificial Sequence; identical to SEQ ID NO: 77611
  derived and/or modified sequence opt1 from neuraminidase__InfluenzaA__ACN43017

SEQ ID NO: 77650 - RNA, 1410 nt, Artificial Sequence; identical to SEQ ID NO: 77607
  derived and/or modified sequence opt1 from neuraminidase__InfluenzaA__ACN43028

SEQ ID NO: 77651 - RNA, 1410 nt, Artificial Sequence
  derived and/or modified sequence opt1 from neuraminidase__InfluenzaA__ACN43039
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccuggagacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcgggaaggccgacaccaagauccucuucaucgaggagggcaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcgggcuggugggcgacacgccccggaagaacgacuccagcuccagcucccacugccucgaccccaacaacgaggagggcgggcacggcgucaaggggugggccuucgacgacggcaacgacguguggauggggcgcaccaucagcgagaagucccggcugggcuacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 77652 - RNA, 1410 nt, Artificial Sequence; identical to SEQ ID NO: 77520
  derived and/or modified sequence opt1 from neuraminidase__InfluenzaA__ACN43050

SEQ ID NO: 77653 - RNA, 1410 nt, Artificial Sequence; identical to SEQ ID NO: 77607
  derived and/or modified sequence opt1 from neuraminidase__InfluenzaA__ACN43061

SEQ ID NO: 77654 - RNA, 1410 nt, Artificial Sequence
  derived and/or modified sequence opt1 from neuraminidase__InfluenzaA__ACN43072
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcgucgugguguucugcggcaccuccgggacguacggcaccgggagcuggccggacggcgccgacaucaaccugaugcccaucuga

SEQ ID NO: 77655 - RNA, 1410 nt, Artificial Sequence
  derived and/or modified sequence opt1 from neuraminidase__InfluenzaA__ACN43083
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaacgagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 77656 - RNA, 1410 nt, Artificial Sequence; identical to SEQ ID NO: 75335
  derived and/or modified sequence opt1 from neuraminidase__InfluenzaA__ACN50231

SEQ ID NO: 77657 - RNA, 1410 nt, Artificial Sequence
  derived and/or modified sequence opt1 from neuraminidase__InfluenzaA__ACN50233
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccgugguccucaccgacggguccgccagcggcaaggccgacaccaagauccuguucaucgaggagggcaagaucgugcacacgagcaagcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccucgugggcgacacgccccgcaagaacgacuccagcuccagcgggcacugccuggaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcuccagaucaaccgccaggugaucguggaccgggggaaccgguccggcuacagcgggaucuucuccgucgagggcaagagcugcaucaaccgcugcuucuacguggagcugauccggggccgcaaggaggagaccgaggugcuguggaccagcaacuccaucgucguguucugcgggaccagcggcaccuacgggacgggcuccuggccggacggggccgacaucaaccucaugcccaucuga

SEQ ID NO: 77658 - RNA, 1410 nt, Artificial Sequence
  derived and/or modified sequence opt1 from neuraminidase__InfluenzaA__ACN50245
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77659 - RNA, 1413 nt, Artificial Sequence
  derived and/or modified sequence opt1 from neuraminidase__InfluenzaA__ACN72609
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuacaagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 77660 - RNA, 1410 nt, Artificial Sequence
  derived and/or modified sequence opt1 from neuraminidase__InfluenzaA__ACN72621
augaaccccaaccagaagaucaucaucaucagcuccaucugcaugaccaacggcaucgccagccugauccuccagaucgggaacaucaucuccaucuggaucagccacuccauccagaccggcaaccagaaccagacggagaccugcaaccagagcgugaucaucuacgagaacaacaccugggucaaccagaccuacgugaacaucuccaacaacaacuucguggccgagcagacggucgugccggugaagcuggucgggagcagcccccugugccccgugagcggcugggcgaucuacuccaaggacaacagcgugcgcaucggguccaagggcgacgucuucgugauccgggagcccuucaucagcugcucccaccucgagugccgcaccuucuuccugacccagggcgcccugcucaacgacaagcacagcaacgggaccgugaaggaccgguccccguaccgcacgcugaugagcugccccaucggcgagguccccucccccuacaacagccgguucgagagcguggccugguccgccagcgccugccacgacggguccagcuggcugaccaucggcaucuccgggccggacaacggcgcgguggccguccucaaguacaacgacaucaucaccgacaccaucaagagcuggaagaacaacauccugcgcacgcaggaguccgagugcgccugccugaacggcagcugcuucaccgugaugaccgacgggcccuccaacggccaggccagcuacaagaucuucaagaucgagaaggggaagguggucaaguccguggagcucaacgcgcccaacuaccacuacgaggagugcagcugcuaccccgacuccggcgagaucaucugcgugugccgggacaacuggcacggcagcaaccgcccgugggucuccuucaaccagaaccuggaguaccagaucggguacaucugcagcggcgugcugggggacaacccccggcccaacgaccgcaccggcaacugcgggcccguguccagccacggcgccaacggcgucaagggguucuccuucaaguacggcgacgggaucuggaucggccggacgaaguccaccagcucccgcagcggguucgagaugaucugggacccgaacggcuggaccggcaccgacaacaacuucuccgugaagcaggacaucgucgggaucacggacuggaccggcuacagcggguccuucgugcagcaccccgagcucaccggccuggacugcauccggcccugcuucuggguggagcugauccgcgggcggcccaaggagaacaccaucuggacgagcggcuccagcaucuccuucugcggcgucaacagcgacaccguggggugguccuggccggacggcgccgagcuccccuucaccaucgacaaguga

SEQ ID NO: 77661 - RNA, 1410 nt, Artificial Sequence; identical to SEQ ID NO: 77520
  derived and/or modified sequence opt1 from neuraminidase__InfluenzaA__ACN76503

SEQ ID NO: 77662 - RNA, 1410 nt, Artificial Sequence
  derived and/or modified sequence opt1 from neuraminidase__InfluenzaA__ACO36345
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcagugcgagcccacgaucaucgagcgcaacaucaccgagaucguguaccugaccaacaccacgaucgagaaggagaucugccccaagcucgccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccugggccaggggaccacgcucaacaacgugcacagcaacaacaccguccgcgaccggacccccuaccgcacccugcugaugaacgagcucggcgugccguuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcaucguguccuggagcaaggagauccugcgcacccaggaguccgagugcgucugcaucaacggcacgugcaccguggugaugaccgacgggagcgccagcggcaaggccgacaccaagauccuguucaucgaggagggcaagaucguccacacguccacccucagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccuggaccccaacaacgaggagggcgggcacggggugaagggcugggccuucgacgacgggaacgacgucuggaugggccgcaccaucuccgagaagucccggcucggcuacgagacguucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcugauccgcggccggaaggaggagaccgaggugcucuggaccagcaacuccaucguggucuucugcggcaccagcgggacguacggcaccggguccuggcccgacggcgccgacaucaaccugaugccgaucuga

SEQ ID NO: 77663 - RNA, 1410 nt, Artificial Sequence; identical to SEQ ID NO: 75988
  derived and/or modified sequence opt1 from neuraminidase__InfluenzaA__ACO36356

SEQ ID NO: 77664 - RNA, 1410 nt, Artificial Sequence
  derived and/or modified sequence opt1 from neuraminidase__InfluenzaA__ACO36367
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguucggcaccgggagcuggccggacggcgccgacaucaaccugaugcccaucuga

SEQ ID NO: 77665 - RNA, 1413 nt, Artificial Sequence; identical to SEQ ID NO: 77640
  derived and/or modified sequence opt1 from neuraminidase__InfluenzaA__ACO36400

SEQ ID NO: 77666 - RNA, 1410 nt, Artificial Sequence
  derived and/or modified sequence opt1 from neuraminidase__InfluenzaA__ACO36411
augaaccccaaccagaagaucaucaccaucggcagcgugucccugaccaucagcacgaucggguucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacagcauccgccuguccgccgggggcgacaucugggucacccgggagcccuacgugagcugcgaccccgacaagugcuaccaguucgcccucgggcagggcacgacccugaacaacgugcacuccaacgacaccguccgcggccggaccccguaccgcacgcugcucaugaacgagcugggggugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggcuccgccagcgggaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaagggcagcaaccgcccgaucguggacaucaacaucaaggaccacuccaucgugagcuccuacgucugcagcgggcuggugggcgacacgccccggaagaacgacuccagcuccagcucccacugccucgaccccaacaacgaggagggcggccacggggugaagggcugggccuucgacgacggcaacgacgucuggauggggcgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 77667 - RNA, 1410 nt, Artificial Sequence
  derived and/or modified sequence opt1 from neuraminidase__InfluenzaA__ACO36422
augaaccccaaccagaagaucaucaccaucggcagcgugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 77668 - RNA, 1410 nt, Artificial Sequence; identical to SEQ ID NO: 77424
  derived and/or modified sequence opt1 from neuraminidase__InfluenzaA__ACO36433

SEQ ID NO: 77669 - RNA, 1410 nt, Artificial Sequence
  derived and/or modified sequence opt1 from neuraminidase__InfluenzaA__ACO36444
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgagaaggcggacaccaagauccuguucaucgaggaggggaagaucguccacaucagcacgcugagcggcuccgcccagcacguggaggagugcagcugcuacccccgguaccccggggugcgcugcgucugccgggacaacuggaagggcuccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaaggggugggccuucgacgacggcaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccgggaucuucagcgucgagggcaaguccugcaucaaccggugcuucuacguggagcugauccgcggccggaaggaggagaccgaggugugguggaccagcaacagcaucgucguguucugcgggaccuccggcaccuacgggacgggcagcuggccggacggggccgacaucaaccugaugcccaucuga

SEQ ID NO: 77670 - RNA, 1410 nt, Artificial Sequence
  derived and/or modified sequence opt1 from neuraminidase__InfluenzaA__ACO36466
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucgccuaccucaccaacaccacgaucgagaaggagaucugccccaagcuggcggaguaccggaacuggagcaagccgcagugcaacaucaccggguucgcccccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcaucgccuggagcuccagcuccugccacgacgggaaggcguggcuccacgugugcgugaccggcgacgacgagaacgccaccgccagcuucaucuacaacgggcgccugguggacuccguggucagcugguccaagaagauccugcggacccaggagagcgagugcgugugcaucaacggcacgugcaccguggucaugaccgacggguccgccagcggcaaggcggacaccaagauccucuucaucgaggagggcaagaucgugcacacgagcacccuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 77671 - RNA, 1410 nt, Artificial Sequence
  derived and/or modified sequence opt1 from neuraminidase__InfluenzaA__ACO36477
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaacauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 77672 - RNA, 1410 nt, Artificial Sequence
  derived and/or modified sequence opt1 from neuraminidase__InfluenzaA__ACO36499
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaagaagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaccaggagaccgagguccuguggaccuccaacagcaucgugguguucugcggcaccuccgggacguacggcaccgggagcuggccggacggcgccgacaucaaccugaugcccaucuga

SEQ ID NO: 77673 - RNA, 1410 nt, Artificial Sequence; identical to SEQ ID NO: 75335
  derived and/or modified sequence opt1 from neuraminidase__InfluenzaA__ACO36510

SEQ ID NO: 77674 - RNA, 1410 nt, Artificial Sequence; identical to SEQ ID NO: 75335
  derived and/or modified sequence opt1 from neuraminidase__InfluenzaA__ACO36543

SEQ ID NO: 77675 - RNA, 1410 nt, Artificial Sequence; identical to SEQ ID NO: 75335
  derived and/or modified sequence opt1 from neuraminidase__InfluenzaA__ACO36554

SEQ ID NO: 77676 - RNA, 1410 nt, Artificial Sequence; identical to SEQ ID NO: 75335
  derived and/or modified sequence opt1 from neuraminidase__InfluenzaA__ACO36565

SEQ ID NO: 77677 - RNA, 1410 nt, Artificial Sequence
  derived and/or modified sequence opt1 from neuraminidase__InfluenzaA__ACO36576
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucgugggccgggggaaccggagcggcuacuccgggaucuucagcgucgagggcaagagcugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 77678 - RNA, 1410 nt, Artificial Sequence; identical to SEQ ID NO: 75335
  derived and/or modified sequence opt1 from neuraminidase__InfluenzaA__ACO36587

SEQ ID NO: 77679 - RNA, 1410 nt, Artificial Sequence; identical to SEQ ID NO: 75720
  derived and/or modified sequence opt1 from neuraminidase__InfluenzaA__ACO36609

SEQ ID NO: 77680 - RNA, 1410 nt, Artificial Sequence
  derived and/or modified sequence opt1 from neuraminidase__InfluenzaA__ACO36620
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccaggugaaccgccaggugaucgucgaccggggcaaccggagcggguacuccggcaucuucagcguggagggcaagagcugcaucaaccgcugcuucuacguggagcugauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 77681 - RNA, 1410 nt, Artificial Sequence; identical to SEQ ID NO: 75720
  derived and/or modified sequence opt1 from neuraminidase__InfluenzaA__ACO36631

SEQ ID NO: 77682 - RNA, 1410 nt, Artificial Sequence; identical to SEQ ID NO: 75720
  derived and/or modified sequence opt1 from neuraminidase__InfluenzaA__ACO36653

SEQ ID NO: 77683 - RNA, 1410 nt, Artificial Sequence
  derived and/or modified sequence opt1 from neuraminidase__InfluenzaA__ACO36675
augaaccccaaccagaagaucaucaccaucggcagcgugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcaacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccucgugggcgacacgccccgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 77684 - RNA, 1410 nt, Artificial Sequence
  derived and/or modified sequence opt1 from neuraminidase__InfluenzaA__ACO36686
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccacgacaagugcuaccaguucgcccucggccaggggaccacgcugaacaacgugcacuccaacgacaccguccacgaccgcacccccuaccggacccugcucaugaacgagcugggcgugccguuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcagcggccuggugggcgacaccccgcgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggcccgacggcgccgacaucaaccugaugccgaucuga

SEQ ID NO: 77685 - RNA, 1410 nt, Artificial Sequence
  derived and/or modified sequence opt1 from neuraminidase__InfluenzaA__ACO37125
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggaugcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77686 - RNA, 1410 nt, Artificial Sequence
  derived and/or modified sequence opt1 from neuraminidase__InfluenzaA__ACO94511
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcuccaacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77687 - RNA, 1410 nt, Artificial Sequence; identical to SEQ ID NO: 77520
  derived and/or modified sequence opt1 from neuraminidase__InfluenzaA__ACO94512

SEQ ID NO: 77688 - RNA, 1410 nt, Artificial Sequence; identical to SEQ ID NO: 77607
  derived and/or modified sequence opt1 from neuraminidase__InfluenzaA__ACO94513

SEQ ID NO: 77689 - RNA, 1410 nt, Artificial Sequence
  derived and/or modified sequence opt1 from neuraminidase__InfluenzaA__ACO94675
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaagaaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77690 - RNA, 1410 nt, Artificial Sequence
  derived and/or modified sequence opt1 from neuraminidase__InfluenzaA__ACO94686
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggacauccugcgcacgcaggagagcgagugcgucugcaucaacgggaccugcaccguggugaugaccgacggcuccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggccggacggggccgagaucaaccugaugcccaucuga

SEQ ID NO: 77691 - RNA, 1410 nt, Artificial Sequence; identical to SEQ ID NO: 77607
  derived and/or modified sequence opt1 from neuraminidase__InfluenzaA__ACO94697

SEQ ID NO: 77692 - RNA, 1413 nt, Artificial Sequence; identical to SEQ ID NO: 77640
  derived and/or modified sequence opt1 from neuraminidase__InfluenzaA__ACO94708

SEQ ID NO: 77693 - RNA, 1410 nt, Artificial Sequence
  derived and/or modified sequence opt1 from neuraminidase__InfluenzaA__ACO94719
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggacauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggaccagcggcacguacgggaccggcuccuggccggacggggccgagaucaaccugaugcccaucuga

SEQ ID NO: 77694 - RNA, 1410 nt, Artificial Sequence
  derived and/or modified sequence opt1 from neuraminidase__InfluenzaA__ACO94741
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaaggagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacagcggcaucuucagcguggaguccaagagcugcaucaaccggugcuucuacgucgagcucauccgcgggcggaaggaggagaccgaggugcuguggaccuccaacagcaucguggucuucugcggcaccuccggcacguacgggaccggcagcuggcccgacggggccgacaucaaccugaugccgaucuga

SEQ ID NO: 77695 - RNA, 1410 nt, Artificial Sequence; identical to SEQ ID NO: 77611
  derived and/or modified sequence opt1 from neuraminidase__InfluenzaA__ACO94763

SEQ ID NO: 77696 - RNA, 1410 nt, Artificial Sequence
  derived and/or modified sequence opt1 from neuraminidase__InfluenzaA__ACO94774
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggcgggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77697 - RNA, 1410 nt, Artificial Sequence
  derived and/or modified sequence opt1 from neuraminidase__InfluenzaA__ACO94785
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcaagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77698 - RNA, 1410 nt, Artificial Sequence; identical to SEQ ID NO: 77607
  derived and/or modified sequence opt1 from neuraminidase__InfluenzaA__ACO94796

SEQ ID NO: 77699 - RNA, 1413 nt, Artificial Sequence
  derived and/or modified sequence opt1 from neuraminidase__InfluenzaA__ACO94807
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagccgcuucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccagcaacgggaccgccuccuacaagaucuucaagaucgagaagggcaaggugaccaagaccaucgagcucaacgcccccaacuuccacuacgaggagugcagcugcuacccggacacggggaccgucaugugcgugugccgggacaacuggcacggcuccaaccgccccugggugagcuucaaccagaaccuggacuaccagaucggguacaucugcuccggcgucuucggcgacaacccccggcccaaggacggggagggcagcugcaacccggugaccguggacggggccgacggcgucaagggguucuccuacaaguacggcaacggcguguggaucgggcgcaccaagagcaaccggcugcgcaagggcuucgagaugaucugggaccccaacggguggacgaacaccgacuccgacuucagcgugaagcaggacgucguggcgaucaccgacugguccggcuacagcgggagcuucgugcagcaccccgagcucaccggccuggacugcauccggcccugcuucugggucgagcuggugcgcggccucccgcgggagaacacgaccaucuggaccuccgggagcuccaucagcuucugcggcgucaacuccgggaccgccaacuggagcuggcccgacggcgccgagcugcccuucacgaucgacaaguga

SEQ ID NO: 77700 - RNA, 1410 nt, Artificial Sequence; identical to SEQ ID NO: 77422
  derived and/or modified sequence opt1 from neuraminidase__InfluenzaA__ACO94818

SEQ ID NO: 77701 - RNA, 1365 nt, Artificial Sequence; identical to SEQ ID NO: 76727
  derived and/or modified sequence opt1 from neuraminidase__InfluenzaA__ACO94829

SEQ ID NO: 77702 - RNA, 1365 nt, Artificial Sequence; identical to SEQ ID NO: 76727
  derived and/or modified sequence opt1 from neuraminidase__InfluenzaA__ACO94840

SEQ ID NO: 77703 - RNA, 1410 nt, Artificial Sequence
  derived and/or modified sequence opt1 from neuraminidase__InfluenzaA__ACO94851
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaucguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 77704 - RNA, 1413 nt, Artificial Sequence; identical to SEQ ID NO: 77640
  derived and/or modified sequence opt1 from neuraminidase__InfluenzaA__ACO94873

SEQ ID NO: 77705 - RNA, 1410 nt, Artificial Sequence
  derived and/or modified sequence opt1 from neuraminidase__InfluenzaA__ACO94884
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 77706 - RNA, 1410 nt, Artificial Sequence; identical to SEQ ID NO: 75722
  derived and/or modified sequence opt1 from neuraminidase__InfluenzaA__ACO94906

SEQ ID NO: 77707 - RNA, 1410 nt, Artificial Sequence; identical to SEQ ID NO: 75153
  derived and/or modified sequence opt1 from neuraminidase__InfluenzaA__ACO94917

SEQ ID NO: 77708 - RNA, 1410 nt, Artificial Sequence; identical to SEQ ID NO: 75722
  derived and/or modified sequence opt1 from neuraminidase__InfluenzaA__ACO94928

SEQ ID NO: 77709 - RNA, 1410 nt, Artificial Sequence; identical to SEQ ID NO: 75153
  derived and/or modified sequence opt1 from neuraminidase__InfluenzaA__ACO94939

SEQ ID NO: 77710 - RNA, 1410 nt, Artificial Sequence
  derived and/or modified sequence opt1 from neuraminidase__InfluenzaA__ACO94950
augaaccccaaccagaagaucaucaccaucggcagcgugucccugaccaucagcacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaagaagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccucgugggcgacacgccccgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 77711 - RNA, 1410 nt, Artificial Sequence
  derived and/or modified sequence opt1 from neuraminidase__InfluenzaA__ACO94961
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagcugugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaagaagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccucgugggcgacacgccccgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 77712 - RNA, 1410 nt, Artificial Sequence
  derived and/or modified sequence opt1 from neuraminidase__InfluenzaA__ACO94972
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccgucgugagcugguccaagaagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaccaggagaccgagguccuguggaccuccaacagcaucgugguguucugcggcaccuccgggacguacggcaccgggagcuggccggacggcgccgacaucaaccugaugcccaucuga

SEQ ID NO: 77713 - RNA, 1410 nt, Artificial Sequence
  derived and/or modified sequence opt1 from neuraminidase__InfluenzaA__ACO95156
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaagaagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcacguccgggaccuacggcaccgggagcuggccggacggcgccgacaucaaccugaugcccaucuga

SEQ ID NO: 77714 - RNA, 1410 nt, Artificial Sequence; identical to SEQ ID NO: 75335
  derived and/or modified sequence opt1 from neuraminidase__InfluenzaA__ACO95174

SEQ ID NO: 77715 - RNA, 1410 nt, Artificial Sequence; identical to SEQ ID NO: 75335
  derived and/or modified sequence opt1 from neuraminidase__InfluenzaA__ACO95185

SEQ ID NO: 77716 - RNA, 1410 nt, Artificial Sequence
  derived and/or modified sequence opt1 from neuraminidase__InfluenzaA__ACO95196
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccauccacgaccgcaccccguaccggacccugcucaugaacgagcugggcguccccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccguggucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 77717 - RNA, 1410 nt, Artificial Sequence; identical to SEQ ID NO: 75335
  derived and/or modified sequence opt1 from neuraminidase__InfluenzaA__ACO95207

SEQ ID NO: 77718 - RNA, 1410 nt, Artificial Sequence; identical to SEQ ID NO: 75335
  derived and/or modified sequence opt1 from neuraminidase__InfluenzaA__ACO95218

SEQ ID NO: 77719 - RNA, 1410 nt, Artificial Sequence; identical to SEQ ID NO: 75338
  derived and/or modified sequence opt1 from neuraminidase__InfluenzaA__ACO95229

SEQ ID NO: 77720 - RNA, 1410 nt, Artificial Sequence; identical to SEQ ID NO: 75720
  derived and/or modified sequence opt1 from neuraminidase__InfluenzaA__ACO95240

SEQ ID NO: 77721 - RNA, 1410 nt, Artificial Sequence; identical to SEQ ID NO: 75581
  derived and/or modified sequence opt1 from neuraminidase__InfluenzaA__ACO95262

SEQ ID NO: 77722 - RNA, 1410 nt, Artificial Sequence; identical to SEQ ID NO: 77519
  derived and/or modified sequence opt1 from neuraminidase__InfluenzaA__ACO95273

SEQ ID NO: 77723 - RNA, 1410 nt, Artificial Sequence; identical to SEQ ID NO: 77611
  derived and/or modified sequence opt1 from neuraminidase__InfluenzaA__ACO95306

SEQ ID NO: 77724 - RNA, 1413 nt, Artificial Sequence
  derived and/or modified sequence opt1 from neuraminidase__InfluenzaA__ACO95385
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcgacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 77725 - RNA, 1413 nt, Artificial Sequence; identical to SEQ ID NO: 77640
  derived and/or modified sequence opt1 from neuraminidase__InfluenzaA__ACO95407

SEQ ID NO: 77726 - RNA, 1413 nt, Artificial Sequence; identical to SEQ ID NO: 77640
  derived and/or modified sequence opt1 from neuraminidase__InfluenzaA__ACO95418

SEQ ID NO: 77727 - RNA, 1410 nt, Artificial Sequence; identical to SEQ ID NO: 75153
  derived and/or modified sequence opt1 from neuraminidase__InfluenzaA__ACO95429

SEQ ID NO: 77728 - RNA, 1410 nt, Artificial Sequence; identical to SEQ ID NO: 75722
  derived and/or modified sequence opt1 from neuraminidase__InfluenzaA__ACO95440

SEQ ID NO: 77729 - RNA, 1410 nt, Artificial Sequence
  derived and/or modified sequence opt1 from neuraminidase__InfluenzaA__ACO95462
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcucaucuga

SEQ ID NO: 77730 - RNA, 1410 nt, Artificial Sequence; identical to SEQ ID NO: 75720
  derived and/or modified sequence opt1 from neuraminidase__InfluenzaA__ACO95484

SEQ ID NO: 77731 - RNA, 1410 nt, Artificial Sequence; identical to SEQ ID NO: 75720
  derived and/or modified sequence opt1 from neuraminidase__InfluenzaA__ACO95495

SEQ ID NO: 77732 - RNA, 1410 nt, Artificial Sequence; identical to SEQ ID NO: 75720
  derived and/or modified sequence opt1 from neuraminidase__InfluenzaA__ACO95506

SEQ ID NO: 77733 - RNA, 1410 nt, Artificial Sequence
  derived and/or modified sequence opt1 from neuraminidase__InfluenzaA__ACO95517
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 77734 - RNA, 1410 nt, Artificial Sequence
  derived and/or modified sequence opt1 from neuraminidase__InfluenzaA__ACO95539
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccaacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77735 - RNA, 1413 nt, Artificial Sequence
  derived and/or modified sequence opt1 from neuraminidase__InfluenzaA__ACP20223
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccgugaccgacuggagcggcuacagcggguccuucguccagcaccccgagcucacgggccuggacugcauccggcccugcuucuggguggagcugguccgcggccucccgcgggagaacaccaccaucuggaccagcggguccagcaucuccuucugcggcgugaacagcgacacggccaacugguccuggcccgacggggccgagcugcccuucaccaucgacaaguga

SEQ ID NO: 77736 - RNA, 1410 nt, Artificial Sequence
  derived and/or modified sequence opt1 from neuraminidase__InfluenzaA__ACP41952
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 77737 - RNA, 1410 nt, Artificial Sequence; identical to SEQ ID NO: 77736
  derived and/or modified sequence opt1 from neuraminidase__InfluenzaA__ACP44158

SEQ ID NO: 77738 - RNA, 1413 nt, Artificial Sequence
  derived and/or modified sequence opt1 from neuraminidase__InfluenzaA__ACP44195
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcgacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccugaacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 77739 - RNA, 1413 nt, Artificial Sequence; identical to SEQ ID NO: 77640
  derived and/or modified sequence opt1 from neuraminidase__InfluenzaA__ACP44217

SEQ ID NO: 77740 - RNA, 1413 nt, Artificial Sequence; identical to SEQ ID NO: 77640
  derived and/or modified sequence opt1 from neuraminidase__InfluenzaA__ACP44228

SEQ ID NO: 77741 - RNA, 1410 nt, Artificial Sequence; identical to SEQ ID NO: 75722
  derived and/or modified sequence opt1 from neuraminidase__InfluenzaA__ACP44239

SEQ ID NO: 77742 - RNA, 1410 nt, Artificial Sequence
  derived and/or modified sequence opt1 from neuraminidase__InfluenzaA__ACP44250
augaaccccaaccagaagaucaucaccaucggcagcgugucccugaccaucagcacgaucugcuucuucaugcagaucgccauccucaugaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77743 - RNA, 1410 nt, Artificial Sequence
  derived and/or modified sequence opt1 from neuraminidase__InfluenzaA__ACP44261
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacaugcacuccaacgacaccgugcacgaccgcaccccguaccggacccugcucaugaacgagcugggcguccccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgugagcugguccaaggagauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 77744 - RNA, 1410 nt, Artificial Sequence
  derived and/or modified sequence opt1 from neuraminidase__InfluenzaA__ACP44272
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccgugaucaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 77745 - RNA, 1410 nt, Artificial Sequence; identical to SEQ ID NO: 77736
  derived and/or modified sequence opt1 from neuraminidase__InfluenzaA__ACQ55360

SEQ ID NO: 77746 - RNA, 1410 nt, Artificial Sequence
  derived and/or modified sequence opt1 from neuraminidase__InfluenzaA__ACQ63236
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 77747 - RNA, 1410 nt, Artificial Sequence; identical to SEQ ID NO: 77746
  derived and/or modified sequence opt1 from neuraminidase__InfluenzaA__ACQ63242

SEQ ID NO: 77748 - RNA, 1410 nt, Artificial Sequence; identical to SEQ ID NO: 77746
  derived and/or modified sequence opt1 from neuraminidase__InfluenzaA__ACQ63253

SEQ ID NO: 77749 - RNA, 1410 nt, Artificial Sequence; identical to SEQ ID NO: 77746
  derived and/or modified sequence opt1 from neuraminidase__InfluenzaA__ACQ63262

SEQ ID NO: 77750 - RNA, 1410 nt, Artificial Sequence
  derived and/or modified sequence opt1 from neuraminidase__InfluenzaA__ACQ65694
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggagcaaccggccgaucguggacaucaacaugaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 77751 - RNA, 1410 nt, Artificial Sequence
  derived and/or modified sequence opt1 from neuraminidase__InfluenzaA__ACQ65705
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggagcaaccggccgaucguggacaucaacaugaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 77752 - RNA, 1410 nt, Artificial Sequence; identical to SEQ ID NO: 77520
  derived and/or modified sequence opt1 from neuraminidase__InfluenzaA__ACQ65716

SEQ ID NO: 77753 - RNA, 1410 nt, Artificial Sequence; identical to SEQ ID NO: 77520
  derived and/or modified sequence opt1 from neuraminidase__InfluenzaA__ACQ65727

SEQ ID NO: 77754 - RNA, 1410 nt, Artificial Sequence; identical to SEQ ID NO: 77607
  derived and/or modified sequence opt1 from neuraminidase__InfluenzaA__ACQ65739

SEQ ID NO: 77755 - RNA, 1410 nt, Artificial Sequence
  derived and/or modified sequence opt1 from neuraminidase__InfluenzaA__ACQ65750
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcaaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 77756 - RNA, 1413 nt, Artificial Sequence; identical to SEQ ID NO: 77640
  derived and/or modified sequence opt1 from neuraminidase__InfluenzaA__ACQ65761

SEQ ID NO: 77757 - RNA, 1410 nt, Artificial Sequence; identical to SEQ ID NO: 77736
  derived and/or modified sequence opt1 from neuraminidase__InfluenzaA__ACQ73394

SEQ ID NO: 77758 - RNA, 1410 nt, Artificial Sequence; identical to SEQ ID NO: 77736
  derived and/or modified sequence opt1 from neuraminidase__InfluenzaA__ACQ73395

SEQ ID NO: 77759 - RNA, 1410 nt, Artificial Sequence; identical to SEQ ID NO: 77746
  derived and/or modified sequence opt1 from neuraminidase__InfluenzaA__ACQ73396

SEQ ID NO: 77760 - RNA, 1410 nt, Artificial Sequence; identical to SEQ ID NO: 77746
  derived and/or modified sequence opt1 from neuraminidase__InfluenzaA__ACQ76291

SEQ ID NO: 77761 - RNA, 1410 nt, Artificial Sequence
  derived and/or modified sequence opt1 from neuraminidase__InfluenzaA__ACQ76298
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 77762 - RNA, 1410 nt, Artificial Sequence; identical to SEQ ID NO: 77746
  derived and/or modified sequence opt1 from neuraminidase__InfluenzaA__ACQ76308

SEQ ID NO: 77763 - RNA, 1410 nt, Artificial Sequence; identical to SEQ ID NO: 77746
  derived and/or modified sequence opt1 from neuraminidase__InfluenzaA__ACQ76316

SEQ ID NO: 77764 - RNA, 1410 nt, Artificial Sequence; identical to SEQ ID NO: 77736
  derived and/or modified sequence opt1 from neuraminidase__InfluenzaA__ACQ76322

SEQ ID NO: 77765 - RNA, 1410 nt, Artificial Sequence; identical to SEQ ID NO: 77736
  derived and/or modified sequence opt1 from neuraminidase__InfluenzaA__ACQ76328

SEQ ID NO: 77766 - RNA, 1410 nt, Artificial Sequence; identical to SEQ ID NO: 77736
  derived and/or modified sequence opt1 from neuraminidase__InfluenzaA__ACQ76335

SEQ ID NO: 77767 - RNA, 1410 nt, Artificial Sequence; identical to SEQ ID NO: 77736
  derived and/or modified sequence opt1 from neuraminidase__InfluenzaA__ACQ76342

SEQ ID NO: 77768 - RNA, 1410 nt, Artificial Sequence; identical to SEQ ID NO: 77736
  derived and/or modified sequence opt1 from neuraminidase__InfluenzaA__ACQ76351

SEQ ID NO: 77769 - RNA, 1410 nt, Artificial Sequence; identical to SEQ ID NO: 77736
  derived and/or modified sequence opt1 from neuraminidase__InfluenzaA__ACQ76359

SEQ ID NO: 77770 - RNA, 1410 nt, Artificial Sequence; identical to SEQ ID NO: 77746
  derived and/or modified sequence opt1 from neuraminidase__InfluenzaA__ACQ76364

SEQ ID NO: 77771 - RNA, 1410 nt, Artificial Sequence; identical to SEQ ID NO: 77746
  derived and/or modified sequence opt1 from neuraminidase__InfluenzaA__ACQ76367

SEQ ID NO: 77772 - RNA, 1410 nt, Artificial Sequence
  derived and/or modified sequence opt1 from neuraminidase__InfluenzaA__ACQ76379
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacaagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 77773 - RNA, 1410 nt, Artificial Sequence; identical to SEQ ID NO: 77746
  derived and/or modified sequence opt1 from neuraminidase__InfluenzaA__ACQ76385

SEQ ID NO: 77774 - RNA, 1410 nt, Artificial Sequence; identical to SEQ ID NO: 77746
  derived and/or modified sequence opt1 from neuraminidase__InfluenzaA__ACQ76388

SEQ ID NO: 77775 - RNA, 1410 nt, Artificial Sequence; identical to SEQ ID NO: 77746
  derived and/or modified sequence opt1 from neuraminidase__InfluenzaA__ACQ76403

SEQ ID NO: 77776 - RNA, 1410 nt, Artificial Sequence
  derived and/or modified sequence opt1 from neuraminidase__InfluenzaA__ACQ76407
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucggcggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucccgguucgagagcguggccuggagcgcguccgccugccacgacggcaucaacuggcucaccaucggcaucagcgggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 77777 - RNA, 1410 nt, Artificial Sequence
  derived and/or modified sequence opt1 from neuraminidase__InfluenzaA__ACQ77603
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagucccgcagcggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggcccgacggcgccgacaucaaccugaugcccaucuga

SEQ ID NO: 77778 - RNA, 1410 nt, Artificial Sequence; identical to SEQ ID NO: 77736
  derived and/or modified sequence opt1 from neuraminidase__InfluenzaA__ACQ83309

SEQ ID NO: 77779 - RNA, 1410 nt, Artificial Sequence; identical to SEQ ID NO: 77736
  derived and/or modified sequence opt1 from neuraminidase__InfluenzaA__ACQ84460

SEQ ID NO: 77780 - RNA, 1410 nt, Artificial Sequence; identical to SEQ ID NO: 77736
  derived and/or modified sequence opt1 from neuraminidase__InfluenzaA__ACQ84470

SEQ ID NO: 77781 - RNA, 1410 nt, Artificial Sequence
  derived and/or modified sequence opt1 from neuraminidase__InfluenzaA__ACQ84480
augaacaccaaccagcgcaucaucaccaucggcacggugugccugaucgucgggaucgugagccuccugcugcagaucggcaacaucgugucccucuggaucagccacuccaucaagaccggggagaagaaccacagcgagaucugcaaccagaacaucaucaccuacgagaacaagaccugggucaaccagacguacgugaacaucuccaacaccaacaucgccgacggccagggggugaccagcaucauccuggccggcaacuccagccugugccccaucuccggcugggcgaucuacagcaaggacaacuccauccggaucgggagcaagggcgacaucuucgucauccgcgagccguucaucuccugcagccaccucgagugccggaccuucuuccugacgcagggggcccugcucaacgaccgccacuccaacggcaccgugaaggaccggagccccuaccgcacccugauguccugccccaccggggaggcccccagcccguacaacucccgguucgagagcguggccuggagcgccuccgcgugccacgacggcaugggcuggcugacgaucgggaucagcggccccgacaacggggccgucgccgugcucaaguacaacggcaucaucaccgacaccaucaaguccuggcgcaacaagauccugcggacccaggagagcgagugcgugugcaucaacggcuccugcuucacgaucaugaccgacgggcccagcaacggccaggccuccuacaagaucuucaagauggagaaggggaagaucaucaagagcgucgagcuggacgcgcccaacuaccacuacgaggagugcuccugcuacccggacaccggcaagguggugugcgucugccgcgacaacuggcacgccagcaaccggcccuggguguccuucgaccagaaccucgacuaccagaucggguacaucugcagcggcguguucggcgacaacccccgcuccaacgacgggaagggcaacugcgggcccguccugagcaacggcgccaacggggugaagggcuucuccuuccgguacggcaacgggguguggaucggccgcaccaagagcaucuccagccgguccggguucgagaugaucugggacccgaacggcuggacggagaccgacagcagcuucuccaucaagcaggacaucaucgcccugaccgacuggagcggguacuccggcagcuucguccagcaccccgagcucaccggcaugaacugcauccgccccugcuucuggguggagcugauccgggggcagcccaaggaguccacgaucuggaccagcggcuccagcaucuccuucugcgggguggacagcgagaccgccuccuggagcuggccggacggcgcggaccugcccuucaccaucgacaaguga

SEQ ID NO: 77782 - RNA, 1410 nt, Artificial Sequence
  derived and/or modified sequence opt1 from neuraminidase__InfluenzaA__ACQ89891
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugccggggcaucuucggggacaacccgcgccccaacgacaagaccggcuccugcggccccgugagcuccaacggggccaacggcgugaagggguucagcuucaaguacggcaacggggucuggaucggccggaccaaguccaucagcagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 77783 - RNA, 1410 nt, Artificial Sequence; identical to SEQ ID NO: 77736
  derived and/or modified sequence opt1 from neuraminidase__InfluenzaA__ACQ89918

SEQ ID NO: 77784 - RNA, 1410 nt, Artificial Sequence
  derived and/or modified sequence opt1 from neuraminidase__InfluenzaA__ACQ89919
augaaccccaaccagaagaucaucaccaucggcagcgugugcaugaccaucgggauggccaaccugauccuccagaucggcaacaucaucuccaucuggaucagccgcuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcggaucggcuccaagggggacguguucgucauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggagcugcuucaccgucaugaccgacggcccguccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 77785 - RNA, 1410 nt, Artificial Sequence; identical to SEQ ID NO: 77746
  derived and/or modified sequence opt1 from neuraminidase__InfluenzaA__ACQ89920

SEQ ID NO: 77786 - RNA, 1410 nt, Artificial Sequence; identical to SEQ ID NO: 77746
  derived and/or modified sequence opt1 from neuraminidase__InfluenzaA__ACQ89921

SEQ ID NO: 77787 - RNA, 1410 nt, Artificial Sequence; identical to SEQ ID NO: 77736
  derived and/or modified sequence opt1 from neuraminidase__InfluenzaA__ACQ89922

SEQ ID NO: 77788 - RNA, 1410 nt, Artificial Sequence; identical to SEQ ID NO: 77746
  derived and/or modified sequence opt1 from neuraminidase__InfluenzaA__ACQ89923

SEQ ID NO: 77789 - RNA, 1410 nt, Artificial Sequence; identical to SEQ ID NO: 77736
  derived and/or modified sequence opt1 from neuraminidase__InfluenzaA__ACQ99623

SEQ ID NO: 77790 - RNA, 1410 nt, Artificial Sequence; identical to SEQ ID NO: 77746
  derived and/or modified sequence opt1 from neuraminidase__InfluenzaA__ACQ99624

SEQ ID NO: 77791 - RNA, 1410 nt, Artificial Sequence; identical to SEQ ID NO: 77736
  derived and/or modified sequence opt1 from neuraminidase__InfluenzaA__ACQ99626

SEQ ID NO: 77792 - RNA, 1410 nt, Artificial Sequence; identical to SEQ ID NO: 77736
  derived and/or modified sequence opt1 from neuraminidase__InfluenzaA__ACQ99627

SEQ ID NO: 77793 - RNA, 1410 nt, Artificial Sequence; identical to SEQ ID NO: 77736
  derived and/or modified sequence opt1 from neuraminidase__InfluenzaA__ACQ99628

SEQ ID NO: 77794 - RNA, 1410 nt, Artificial Sequence; identical to SEQ ID NO: 77736
  derived and/or modified sequence opt1 from neuraminidase__InfluenzaA__ACQ99629

SEQ ID NO: 77795 - RNA, 1410 nt, Artificial Sequence; identical to SEQ ID NO: 77736
  derived and/or modified sequence opt1 from neuraminidase__InfluenzaA__ACQ99630

SEQ ID NO: 77796 - RNA, 1410 nt, Artificial Sequence; identical to SEQ ID NO: 77746
  derived and/or modified sequence opt1 from neuraminidase__InfluenzaA__ACQ99632

SEQ ID NO: 77797 - RNA, 1410 nt, Artificial Sequence; identical to SEQ ID NO: 77746
  derived and/or modified sequence opt1 from neuraminidase__InfluenzaA__ACQ99633

SEQ ID NO: 77798 - RNA, 1410 nt, Artificial Sequence; identical to SEQ ID NO: 77736
  derived and/or modified sequence opt1 from neuraminidase__InfluenzaA__ACQ99635

SEQ ID NO: 77799 - RNA, 1410 nt, Artificial Sequence; identical to SEQ ID NO: 77736
  derived and/or modified sequence opt1 from neuraminidase__InfluenzaA__ACQ99636

SEQ ID NO: 77800 - RNA, 1410 nt, Artificial Sequence
  derived and/or modified sequence opt1 from neuraminidase__InfluenzaA__ACQ99684
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacgagcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 77801 - RNA, 1410 nt, Artificial Sequence
  derived and/or modified sequence opt1 from neuraminidase__InfluenzaA__ACQ99824
augaacaccaaccagcgcaucaucaccaucggcacgaucugccugaucguggggaucaucagccuccugcugcagaucggcaacaucauccuccuguggaugucccacagcauccagaccggggagaagucccaccccaaggucugcaaccagagcgugaucaccuacgagaacaacaccugggugaaccagacguacgucaacaucuccaacaccaacaucgccgccggccagggggugaccccgaucauccuggcgggcaacagcucccucugccccaucagcggcugggccaucuacuccaaggacaacagcauccggaucggguccaagggcgacaucuucgugaugcgcgagcccuucaucagcugcucccaccuggagugccggaccuucuuccugacgcagggggcccuccugaacgaccgccacagcaacggcaccgucaaggaccggucccccuaccgcacccugaugagcugcccgaucggggaggcccccucccccuacaacagccgguucgaguccguggccuggagcgcgagcgccugccacgacggcaugggcuggcucaccaucgggaucuccggccccgacaacggggccguggccguccugaaguacaacggcaucaucacggacaccaucaagagcuggcgcaacaagauccugcggacccaggaguccgagugcgugugcaucaacggcagcugcuucaccaucaugacggacgggccguccaacggccaggcgagcuacaagcuguucaagauggagaaggggaagaucaucaaguccaucgagcucgacgcccccaacuaccacuacgaggagugcagcugcuaccccgacaccggcaagguggucugcgugugccgcgacaacuggcacgccuccaaccggcccugggugagcuucgaccagaaccuggacuaccagaucggguacaucugcuccggcgucuucggcgacaacccgcgcagcaacgacgggaagggcaacugcgggcccgugcucuccaacggcgccaacggggugaagggcuucagcuuccgguacggcaacggggucuggaucggccgcaccaaguccaucagcucccggagcggguucgagaugaucugggaccccaacggcuggaccgagacggacuccagcuucagcaugaagcaggacaucaucgcccugaccgacugguccggguacagcggcuccuucgugcagcaccccgagcugaccggcaugaacugcauccgcccgugcuucuggguggagcucauccgggggcagcccaaggagagcaccaucuggacguccggcagcuccaucagcuucugcggggucaacuccggcaccgcgagcugguccuggcccgacggcgccgaccugcccuucaccaucgacaaguga

SEQ ID NO: 77802 - RNA, 1410 nt, Artificial Sequence; identical to SEQ ID NO: 77746
  derived and/or modified sequence opt1 from neuraminidase__InfluenzaA__ACR01015

SEQ ID NO: 77803 - RNA, 1410 nt, Artificial Sequence; identical to SEQ ID NO: 77746
  derived and/or modified sequence opt1 from neuraminidase__InfluenzaA__ACR08422

SEQ ID NO: 77804 - RNA, 1410 nt, Artificial Sequence; identical to SEQ ID NO: 77746
  derived and/or modified sequence opt1 from neuraminidase__InfluenzaA__ACR08432

SEQ ID NO: 77805 - RNA, 1410 nt, Artificial Sequence; identical to SEQ ID NO: 77746
  derived and/or modified sequence opt1 from neuraminidase__InfluenzaA__ACR08442

SEQ ID NO: 77806 - RNA, 1410 nt, Artificial Sequence; identical to SEQ ID NO: 77746
  derived and/or modified sequence opt1 from neuraminidase__InfluenzaA__ACR08452

SEQ ID NO: 77807 - RNA, 1410 nt, Artificial Sequence
  derived and/or modified sequence opt1 from neuraminidase__InfluenzaA__ACR08462
augagccccaaccagaagaucaucaccaucggcuccgugugcaugaccaucgggauggccaaccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 77808 - RNA, 1410 nt, Artificial Sequence
  derived and/or modified sequence opt1 from neuraminidase__InfluenzaA__ACR08565
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccagccucugccccgucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgaggugcccagccccuacaacucccgguucgagagcguggccuggagcgcguccgccugccacgacgggaucaacuggcucaccaucggcaucagcggcccggacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggccccagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccguggguguccuucaaccagaaccucgaguaccagaucggguacaucugcagcggcaucuucggggacaacccccggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucguccagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgccgagcugcccuucacgaucgacaaguga

SEQ ID NO: 77809 - RNA, 1410 nt, Artificial Sequence; identical to SEQ ID NO: 77736
  derived and/or modified sequence opt1 from neuraminidase__InfluenzaA__ACR08566

SEQ ID NO: 77810 - RNA, 1410 nt, Artificial Sequence; identical to SEQ ID NO: 77746
  derived and/or modified sequence opt1 from neuraminidase__InfluenzaA__ACR08567

SEQ ID NO: 77811 - RNA, 1410 nt, Artificial Sequence; identical to SEQ ID NO: 77736
  derived and/or modified sequence opt1 from neuraminidase__InfluenzaA__ACR08568

SEQ ID NO: 77812 - RNA, 1410 nt, Artificial Sequence; identical to SEQ ID NO: 77736
  derived and/or modified sequence opt1 from neuraminidase__InfluenzaA__ACR08569

SEQ ID NO: 77813 - RNA, 1410 nt, Artificial Sequence; identical to SEQ ID NO: 77746
  derived and/or modified sequence opt1 from neuraminidase__InfluenzaA__ACR08570

SEQ ID NO: 77814 - RNA, 1410 nt, Artificial Sequence; identical to SEQ ID NO: 77736
  derived and/or modified sequence opt1 from neuraminidase__InfluenzaA__ACR08571

SEQ ID NO: 77815 - RNA, 1410 nt, Artificial Sequence; identical to SEQ ID NO: 77736
  derived and/or modified sequence opt1 from neuraminidase__InfluenzaA__ACR08572

SEQ ID NO: 77816 - RNA, 1410 nt, Artificial Sequence; identical to SEQ ID NO: 77736
  derived and/or modified sequence opt1 from neuraminidase__InfluenzaA__ACR08573

SEQ ID NO: 77817 - RNA, 1410 nt, Artificial Sequence; identical to SEQ ID NO: 77736
  derived and/or modified sequence opt1 from neuraminidase__InfluenzaA__ACR08574

SEQ ID NO: 77818 - RNA, 1410 nt, Artificial Sequence; identical to SEQ ID NO: 77746
  derived and/or modified sequence opt1 from neuraminidase__InfluenzaA__ACR08576

SEQ ID NO: 77819 - RNA, 1410 nt, Artificial Sequence; identical to SEQ ID NO: 77736
  derived and/or modified sequence opt1 from neuraminidase__InfluenzaA__ACR08577

SEQ ID NO: 77820 - RNA, 1410 nt, Artificial Sequence; identical to SEQ ID NO: 77736
  derived and/or modified sequence opt1 from neuraminidase__InfluenzaA__ACR09378

SEQ ID NO: 77821 - RNA, 1410 nt, Artificial Sequence; identical to SEQ ID NO: 77736
  derived and/or modified sequence opt1 from neuraminidase__InfluenzaA__ACR09379

SEQ ID NO: 77822 - RNA, 1410 nt, Artificial Sequence; identical to SEQ ID NO: 77746
  derived and/or modified sequence opt1 from neuraminidase__InfluenzaA__ACR09380

SEQ ID NO: 77823 - RNA, 1410 nt, Artificial Sequence; identical to SEQ ID NO: 77736
  derived and/or modified sequence opt1 from neuraminidase__InfluenzaA__ACR09381

SEQ ID NO: 77824 - RNA, 1410 nt, Artificial Sequence; identical to SEQ ID NO: 77736
  derived and/or modified sequence opt1 from neuraminidase__InfluenzaA__ACR09382

SEQ ID NO: 77825 - RNA, 1410 nt, Artificial Sequence; identical to SEQ ID NO: 77746
  derived and/or modified sequence opt1 from neuraminidase__InfluenzaA__ACR09383

SEQ ID NO: 77826 - RNA, 1410 nt, Artificial Sequence; identical to SEQ ID NO: 77736
  derived and/or modified sequence opt1 from neuraminidase__InfluenzaA__ACR09384

SEQ ID NO: 77827 - RNA, 1410 nt, Artificial Sequence; identical to SEQ ID NO: 77746
  derived and/or modified sequence opt1 from neuraminidase__InfluenzaA__ACR09385

SEQ ID NO: 77828 - RNA, 1410 nt, Artificial Sequence; identical to SEQ ID NO: 77736
  derived and/or modified sequence opt1 from neuraminidase__InfluenzaA__ACR09386

SEQ ID NO: 77829 - RNA, 1410 nt, Artificial Sequence; identical to SEQ ID NO: 77746
  derived and/or modified sequence opt1 from neuraminidase__InfluenzaA__ACR10189

SEQ ID NO: 77830 - RNA, 1410 nt, Artificial Sequence; identical to SEQ ID NO: 77746
  derived and/or modified sequence opt1 from neuraminidase__InfluenzaA__ACR10226

SEQ ID NO: 77831 - RNA, 1410 nt, Artificial Sequence; identical to SEQ ID NO: 77736
  derived and/or modified sequence opt1 from neuraminidase__InfluenzaA__ACR10236

SEQ ID NO: 77832 - RNA, 1410 nt, Artificial Sequence; identical to SEQ ID NO: 77736
  derived and/or modified sequence opt1 from neuraminidase__InfluenzaA__ACR10237

SEQ ID NO: 77833 - RNA, 1410 nt, Artificial Sequence
  derived and/or modified sequence opt1 from neuraminidase__InfluenzaA__ACR15186
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccggcaccccggcguccgcugcgugugccgggacaacuggcgcgggagcaaccggccgaucguggacaucaacaugaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 77834 - RNA, 1413 nt, Artificial Sequence; identical to SEQ ID NO: 77640
  derived and/or modified sequence opt1 from neuraminidase__InfluenzaA__ACR15197

SEQ ID NO: 77835 - RNA, 1410 nt, Artificial Sequence
  derived and/or modified sequence opt1 from neuraminidase__InfluenzaA__ACR15208
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggacaagggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 77836 - RNA, 1410 nt, Artificial Sequence
  derived and/or modified sequence opt1 from neuraminidase__InfluenzaA__ACR15230
auggaccccaaccagaagaucaucaccaucggcagcgugucccugaccaucagcgccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcaacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggcguggcuccacgugugcgugacgggcgacgacgagaacgccaccgccagcuucaucuacaacgggcgccugguggacuccgucgugagcugguccaagaagauccugcggacccaggagagcgagugcgugugcaucaacgggaccugcacggucgugaugaccgacggguccgccagcggcaaggcggacaccaagauccucuucaucgaggagggcaagaucgugcacaccagcacgcuguccgggagcgcccagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccaacagccacugccucgaccccaacaacgaggagggcggccacggggugaagggcugggccuucgacgacgggaacgacgucuggaugggccggaccaucuccgagaagcugcgcagcggcuacgagaccuucaaggugaucgaggggugguccaaccccaacagcaagcugcagaucaaccgccaggugaucgucgaccggggcaaccgguccggguacagcggcaucuucuccguggagggcaagagcugcaucaaccgcugcuucuacguggagcucauccgggggcgcaaccaggagaccgagguccuguggaccagcaacuccaucgugguguucugcggcaccagcgggaccuacggcacgggguccuggccggacggcgccgacaucaaccugaugcccaucuga

SEQ ID NO: 77837 - RNA, 1413 nt, Artificial Sequence; identical to SEQ ID NO: 77640
  derived and/or modified sequence opt1 from neuraminidase__InfluenzaA__ACR15241

SEQ ID NO: 77838 - RNA, 1410 nt, Artificial Sequence; identical to SEQ ID NO: 76892
  derived and/or modified sequence opt1 from neuraminidase__InfluenzaA__ACR15252

SEQ ID NO: 77839 - RNA, 1413 nt, Artificial Sequence
  derived and/or modified sequence opt1 from neuraminidase__InfluenzaA__ACR15263
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggagcuccgggagcuccaucagcuucugcggcgucaacuccgacaccgccaacuggagcuggcccgacggggccgagcugcccuucacgaucgacaaguga

SEQ ID NO: 77840 - RNA, 1413 nt, Artificial Sequence; identical to SEQ ID NO: 77640
  derived and/or modified sequence opt1 from neuraminidase__InfluenzaA__ACR15274

SEQ ID NO: 77841 - RNA, 1413 nt, Artificial Sequence
  derived and/or modified sequence opt1 from neuraminidase__InfluenzaA__ACR15307
augaaccccaaccagaagaucaucaccaucggcagcaucuccaucaccaucgggaucaucagccugaugcuccagaucggcaacaucaucuccaucugggccagccacuccauccagacggggagccagaaccacaccggcaucugcaaccagcgcaucaucaccuacgagaacaacaccugggugaaccacacguacgucaacaucaacaacaccaacgugguggccgggaaggacaagaccuccgucacccuggcgggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcccccuccccguacaacagcaaguucgagagcguggcgugguccgccagcgccugccacgacggcaugggcuggcucacgaucgggaucuccggccccgacaacggggccguggcgguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacugguccggguacagcggcagcuucguccagcaccccgagcucaccggccuggacugcauccgccccugcuucuggguggagcugguccgggggcucccgcgcgagaacaccacgaucuggaccuccggcagcuccaucagcuucugcggggugaacuccgacaccgccaacuggagcuggcccgacggcgccgagcugcccuucaccaucgacaaguga

SEQ ID NO: 77842 - RNA, 1413 nt, Artificial Sequence
  derived and/or modified sequence opt1 from neuraminidase__InfluenzaA__ACR15318
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagcgccagauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcgaacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 77843 - RNA, 1413 nt, Artificial Sequence
  derived and/or modified sequence opt1 from neuraminidase__InfluenzaA__ACR15329
augaaccccaaccagaagaucaucaccaucggcagcaucuccaucgccaucgggaucaucagccugaugcuccagaucggcaacaucaucuccaucugggccagccacuccauccagacccgcagccagaaccacacgggggugugcaaccagcggaucaucaccuacgagaacuccaccugggucaaccacaccuacgugaacaucaacaacacgaacgugaucgcgggcaaggacaagaccagcgucacccuggccgggaacuccagccugugcuccaucagcggcugggccaucuacaccaaggacaacuccauccgcaucggcagcaagggggacguguucgugauccgggagccguucaucuccugcagccaccucgagugccgcacguucuuccugacccagggcgcccugcucaacgacaagcacuccaacgggaccgucaaggaccggagccccuaccgcgcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcggacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggguacaucugcagcggcguguucggcgacaacccccgccccaaggacggggagggcuccugcaacccggugacggucgacggggcgaacggcgugaagggguucagcuacaaguacggcaacggcguguggaucgggcggaccaaguccaaccgccugcggaagggcuucgagaugaucugggaccccaacggguggaccgacaccgacagcgacuucuccgucaagcaggacgugguggccaucacggacuggagcggcuacagcggguccuucguccagcaccccgagcucaccggccuggacugcauccgccccugcuucuggguggagcugguccggggccucccgaaggagaacaccaccaucuggacgagcggguccagcaucuccuucugcggcgugaacagcgacaccgccaacugguccuggcccgacggggccgagcugcccuucaccaucgacaaguga

SEQ ID NO: 77844 - RNA, 1413 nt, Artificial Sequence; identical to SEQ ID NO: 77640
  derived and/or modified sequence opt1 from neuraminidase__InfluenzaA__ACR15340

SEQ ID NO: 77845 - RNA, 1413 nt, Artificial Sequence; identical to SEQ ID NO: 77640
  derived and/or modified sequence opt1 from neuraminidase__InfluenzaA__ACR15362

SEQ ID NO: 77846 - RNA, 1413 nt, Artificial Sequence; identical to SEQ ID NO: 77640
  derived and/or modified sequence opt1 from neuraminidase__InfluenzaA__ACR15373

SEQ ID NO: 77847 - RNA, 1413 nt, Artificial Sequence
  derived and/or modified sequence opt1 from neuraminidase__InfluenzaA__ACR15428
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccgugagcggcugggccaucuacaccaaggacaacuccauccggaucgggagcaagggcgacguguucgucauccgcgagccguucaucuccugcagccaccucgagugccggacguucuuccugaccaagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggucaccaagagcaucgagcucaacgcccccaacuuccacuacgaggagugcuccugcuacccggacaccggcaucgugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucagcuacaaguacgacaacggcguguggaucgggcgcacgaaguccaaccggcugcgcaagggcuucgagaugaucugggaccccaacggguggaccaacaccgacagcgacuucuccgucaagcaggacgugguggccaucaccgacuggagcggcuacagcggguccuucguccagcaccccgagcucacgggccuggacugcauccggcccugcuucuggguggagcugguccgcggccucccgcgggagaacaccaccaucuggaccagcggguccagcaucuccuucugcggcgugaacagcgacacggccaacugguccuggcccgacggggccgagcugcccuucaccaucgacaaguga

SEQ ID NO: 77848 - RNA, 1413 nt, Artificial Sequence
  derived and/or modified sequence opt1 from neuraminidase__InfluenzaA__ACR15472
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccccggucacccuggccggcaacagcucccugugcagcaucuccggcugggccaucuacaccaaggacaacagcauccggaucggguccaagggcgacguguucgugauccgcgagcccuucaucgccugcagccaccucgagugccggacguucuuccugacccagggggcccugcucaacgacaagcacuccaacggcaccgucaaggaccgcagccccuaccgggcgcugauguccugcccccugggggaggccccgagccccuacaacuccaaguucgagagcguggccuggagcgccuccgcgugccacgacggcaugggcuggcucaccaucgggaucagcggccccgacaacggggccguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcgccgaacuuccacuacgaggagugcuccugcuaccccgacaccggcaucgucaugugcgugugccgggacaacuggcacgggagcaaccgccccuggguguccuucaaccagaaccuggacuaccagaucggcuacaucugcagcggcgucuucggggacaacccccggccggaggacggcgagggguccugcaaccccgugaccguggacggcgccaacggggucaagggcuucagcuacaaguacgacaacggcguguggaucgggcgcacgaaguccaaccggcugcgcaagggcuucgaggugaucugggaccccaacggguggaccaacaccgacagcgacuucuccgucaagcaggacgugguggccaucaccgacuggagcggcuacuccgggagcuucguccagcaccccgagcucacgggccuggacugcauccggccgugcuucuggguggagcugguccgcggccucccccgggagaacaccaccaucuggaccagcggguccagcaucuccuucugcggcgugaacagcgacacggccaacugguccuggcccgacggggccgagcugcccuucaccaucgacaaguga

SEQ ID NO: 77849 - RNA, 1413 nt, Artificial Sequence; identical to SEQ ID NO: 77640
  derived and/or modified sequence opt1 from neuraminidase__InfluenzaA__ACR15483

SEQ ID NO: 77850 - RNA, 1413 nt, Artificial Sequence; identical to SEQ ID NO: 77640
  derived and/or modified sequence opt1 from neuraminidase__InfluenzaA__ACR15505

SEQ ID NO: 77851 - RNA, 1413 nt, Artificial Sequence; identical to SEQ ID NO: 77724
  derived and/or modified sequence opt1 from neuraminidase__InfluenzaA__ACR15516

SEQ ID NO: 77852 - RNA, 1410 nt, Artificial Sequence; identical to SEQ ID NO: 75722
  derived and/or modified sequence opt1 from neuraminidase__InfluenzaA__ACR15527

SEQ ID NO: 77853 - RNA, 1410 nt, Artificial Sequence
  derived and/or modified sequence opt1 from neuraminidase__InfluenzaA__ACR15538
augauccccauccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77854 - RNA, 1410 nt, Artificial Sequence; identical to SEQ ID NO: 75335
  derived and/or modified sequence opt1 from neuraminidase__InfluenzaA__ACR15549

SEQ ID NO: 77855 - RNA, 1410 nt, Artificial Sequence; identical to SEQ ID NO: 75720
  derived and/or modified sequence opt1 from neuraminidase__InfluenzaA__ACR15560

SEQ ID NO: 77856 - RNA, 1410 nt, Artificial Sequence; identical to SEQ ID NO: 75720
  derived and/or modified sequence opt1 from neuraminidase__InfluenzaA__ACR15582

SEQ ID NO: 77857 - RNA, 1410 nt, Artificial Sequence
  derived and/or modified sequence opt1 from neuraminidase__InfluenzaA__ACR15593
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcaggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucguggacuccaucgucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccuggaccccaacaacgaggagggcgggcacggggucaagggcugggccuucgacgacgggaacgacguguggaugggccggaccaucagcgagaagcuccgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 77858 - RNA, 1410 nt, Artificial Sequence
  derived and/or modified sequence opt1 from neuraminidase__InfluenzaA__ACR15604
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcgaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 77859 - RNA, 1410 nt, Artificial Sequence; identical to SEQ ID NO: 77736
  derived and/or modified sequence opt1 from neuraminidase__InfluenzaA__ACR15618

SEQ ID NO: 77860 - RNA, 1410 nt, Artificial Sequence; identical to SEQ ID NO: 77736
  derived and/or modified sequence opt1 from neuraminidase__InfluenzaA__ACR18924

SEQ ID NO: 77861 - RNA, 1410 nt, Artificial Sequence; identical to SEQ ID NO: 77736
  derived and/or modified sequence opt1 from neuraminidase__InfluenzaA__ACR18925

SEQ ID NO: 77862 - RNA, 1410 nt, Artificial Sequence; identical to SEQ ID NO: 77746
  derived and/or modified sequence opt1 from neuraminidase__InfluenzaA__ACR18926

SEQ ID NO: 77863 - RNA, 1410 nt, Artificial Sequence; identical to SEQ ID NO: 77746
  derived and/or modified sequence opt1 from neuraminidase__InfluenzaA__ACR18927

SEQ ID NO: 77864 - RNA, 1410 nt, Artificial Sequence; identical to SEQ ID NO: 77746
  derived and/or modified sequence opt1 from neuraminidase__InfluenzaA__ACR18928

SEQ ID NO: 77865 - RNA, 1410 nt, Artificial Sequence; identical to SEQ ID NO: 77746
  derived and/or modified sequence opt1 from neuraminidase__InfluenzaA__ACR18929

SEQ ID NO: 77866 - RNA, 1410 nt, Artificial Sequence; identical to SEQ ID NO: 77746
  derived and/or modified sequence opt1 from neuraminidase__InfluenzaA__ACR18930

SEQ ID NO: 77867 - RNA, 1410 nt, Artificial Sequence; identical to SEQ ID NO: 77746
  derived and/or modified sequence opt1 from neuraminidase__InfluenzaA__ACR18931

SEQ ID NO: 77868 - RNA, 1410 nt, Artificial Sequence; identical to SEQ ID NO: 77746
  derived and/or modified sequence opt1 from neuraminidase__InfluenzaA__ACR18933

SEQ ID NO: 77869 - RNA, 1410 nt, Artificial Sequence; identical to SEQ ID NO: 77736
  derived and/or modified sequence opt1 from neuraminidase__InfluenzaA__ACR18934

SEQ ID NO: 77870 - RNA, 1410 nt, Artificial Sequence; identical to SEQ ID NO: 77746
  derived and/or modified sequence opt1 from neuraminidase__InfluenzaA__ACR18935

SEQ ID NO: 77871 - RNA, 1410 nt, Artificial Sequence; identical to SEQ ID NO: 77746
  derived and/or modified sequence opt1 from neuraminidase__InfluenzaA__ACR23301

SEQ ID NO: 77872 - RNA, 1410 nt, Artificial Sequence; identical to SEQ ID NO: 77746
  derived and/or modified sequence opt1 from neuraminidase__InfluenzaA__ACR32997

SEQ ID NO: 77873 - RNA, 1410 nt, Artificial Sequence
  derived and/or modified sequence opt1 from neuraminidase__InfluenzaA__ACR33740
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgggaccgucggcugguccuggcccgacggcgccgagcugccguucacgaucgacaaguga

SEQ ID NO: 77874 - RNA, 1410 nt, Artificial Sequence; identical to SEQ ID NO: 77736
  derived and/or modified sequence opt1 from neuraminidase__InfluenzaA__ACR38792

SEQ ID NO: 77875 - RNA, 1410 nt, Artificial Sequence; identical to SEQ ID NO: 77746
  derived and/or modified sequence opt1 from neuraminidase__InfluenzaA__ACR38793

SEQ ID NO: 77876 - RNA, 1410 nt, Artificial Sequence; identical to SEQ ID NO: 77746
  derived and/or modified sequence opt1 from neuraminidase__InfluenzaA__ACR38794

SEQ ID NO: 77877 - RNA, 1410 nt, Artificial Sequence; identical to SEQ ID NO: 77746
  derived and/or modified sequence opt1 from neuraminidase__InfluenzaA__ACR38878

SEQ ID NO: 77878 - RNA, 1410 nt, Artificial Sequence; identical to SEQ ID NO: 77746
  derived and/or modified sequence opt1 from neuraminidase__InfluenzaA__ACR39357

SEQ ID NO: 77879 - RNA, 1410 nt, Artificial Sequence; identical to SEQ ID NO: 77746
  derived and/or modified sequence opt1 from neuraminidase__InfluenzaA__ACR39396

SEQ ID NO: 77880 - RNA, 1410 nt, Artificial Sequence; identical to SEQ ID NO: 77746
  derived and/or modified sequence opt1 from neuraminidase__InfluenzaA__ACR39406

SEQ ID NO: 77881 - RNA, 1410 nt, Artificial Sequence; identical to SEQ ID NO: 77746
  derived and/or modified sequence opt1 from neuraminidase__InfluenzaA__ACR39416

SEQ ID NO: 77882 - RNA, 1410 nt, Artificial Sequence; identical to SEQ ID NO: 77746
  derived and/or modified sequence opt1 from neuraminidase__InfluenzaA__ACR39426

SEQ ID NO: 77883 - RNA, 1410 nt, Artificial Sequence; identical to SEQ ID NO: 77746
  derived and/or modified sequence opt1 from neuraminidase__InfluenzaA__ACR39436

SEQ ID NO: 77884 - RNA, 1410 nt, Artificial Sequence; identical to SEQ ID NO: 77746
  derived and/or modified sequence opt1 from neuraminidase__InfluenzaA__ACR39446

SEQ ID NO: 77885 - RNA, 1410 nt, Artificial Sequence; identical to SEQ ID NO: 77746
  derived and/or modified sequence opt1 from neuraminidase__InfluenzaA__ACR39456

SEQ ID NO: 77886 - RNA, 1410 nt, Artificial Sequence; identical to SEQ ID NO: 77746
  derived and/or modified sequence opt1 from neuraminidase__InfluenzaA__ACR39466

SEQ ID NO: 77887 - RNA, 1410 nt, Artificial Sequence; identical to SEQ ID NO: 77746
  derived and/or modified sequence opt1 from neuraminidase__InfluenzaA__ACR39476

SEQ ID NO: 77888 - RNA, 1410 nt, Artificial Sequence; identical to SEQ ID NO: 77746
  derived and/or modified sequence opt1 from neuraminidase__InfluenzaA__ACR39486

SEQ ID NO: 77889 - RNA, 1410 nt, Artificial Sequence; identical to SEQ ID NO: 77746
  derived and/or modified sequence opt1 from neuraminidase__InfluenzaA__ACR39496

SEQ ID NO: 77890 - RNA, 1410 nt, Artificial Sequence; identical to SEQ ID NO: 77746
  derived and/or modified sequence opt1 from neuraminidase__InfluenzaA__ACR40291

SEQ ID NO: 77891 - RNA, 1410 nt, Artificial Sequence; identical to SEQ ID NO: 77746
  derived and/or modified sequence opt1 from neuraminidase__InfluenzaA__ACR40301

SEQ ID NO: 77892 - RNA, 1410 nt, Artificial Sequence
  derived and/or modified sequence opt1 from neuraminidase__InfluenzaA__ACR40311
augaaccccaaccagaagaucaucaccaucggcagcgugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 77893 - RNA, 1410 nt, Artificial Sequence
  derived and/or modified sequence opt1 from neuraminidase__InfluenzaA__ACR40321
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaacggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 77894 - RNA, 1410 nt, Artificial Sequence; identical to SEQ ID NO: 77746
  derived and/or modified sequence opt1 from neuraminidase__InfluenzaA__ACR40341

SEQ ID NO: 77895 - RNA, 1410 nt, Artificial Sequence; identical to SEQ ID NO: 77746
  derived and/or modified sequence opt1 from neuraminidase__InfluenzaA__ACR40351

SEQ ID NO: 77896 - RNA, 1410 nt, Artificial Sequence; identical to SEQ ID NO: 77746
  derived and/or modified sequence opt1 from neuraminidase__InfluenzaA__ACR40361

SEQ ID NO: 77897 - RNA, 1410 nt, Artificial Sequence; identical to SEQ ID NO: 77746
  derived and/or modified sequence opt1 from neuraminidase__InfluenzaA__ACR40371

SEQ ID NO: 77898 - RNA, 1410 nt, Artificial Sequence; identical to SEQ ID NO: 77746
  derived and/or modified sequence opt1 from neuraminidase__InfluenzaA__ACR40391

SEQ ID NO: 77899 - RNA, 1410 nt, Artificial Sequence; identical to SEQ ID NO: 77736
  derived and/or modified sequence opt1 from neuraminidase__InfluenzaA__ACR46663

SEQ ID NO: 77900 - RNA, 1410 nt, Artificial Sequence; identical to SEQ ID NO: 77736
  derived and/or modified sequence opt1 from neuraminidase__InfluenzaA__ACR46673

SEQ ID NO: 77901 - RNA, 1410 nt, Artificial Sequence
  derived and/or modified sequence opt1 from neuraminidase__InfluenzaA__ACR46996
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 77902 - RNA, 1410 nt, Artificial Sequence; identical to SEQ ID NO: 77901
  derived and/or modified sequence opt1 from neuraminidase__InfluenzaA__ACR46997

SEQ ID NO: 77903 - RNA, 1410 nt, Artificial Sequence; identical to SEQ ID NO: 77901
  derived and/or modified sequence opt1 from neuraminidase__InfluenzaA__ACR46998

SEQ ID NO: 77904 - RNA, 1410 nt, Artificial Sequence; identical to SEQ ID NO: 77901
  derived and/or modified sequence opt1 from neuraminidase__InfluenzaA__ACR46999

SEQ ID NO: 77905 - RNA, 1410 nt, Artificial Sequence; identical to SEQ ID NO: 77901
  derived and/or modified sequence opt1 from neuraminidase__InfluenzaA__ACR47000

SEQ ID NO: 77906 - RNA, 1410 nt, Artificial Sequence; identical to SEQ ID NO: 77901
  derived and/or modified sequence opt1 from neuraminidase__InfluenzaA__ACR47001

SEQ ID NO: 77907 - RNA, 1410 nt, Artificial Sequence; identical to SEQ ID NO: 77901
  derived and/or modified sequence opt1 from neuraminidase__InfluenzaA__ACR47002

SEQ ID NO: 77908 - RNA, 1410 nt, Artificial Sequence; identical to SEQ ID NO: 77901
  derived and/or modified sequence opt1 from neuraminidase__InfluenzaA__ACR47003

SEQ ID NO: 77909 - RNA, 1410 nt, Artificial Sequence
  derived and/or modified sequence opt1 from neuraminidase__InfluenzaA__ACR47008
augaaccccaaccagaagaucaucaccaucggcagcgugugcaugaccaucgggauggccaaccugauccuccagaucggcaacaucaucuccaucuggccgguccacagcauccagcuggggaaccagaaccagaucgagacgugcaaccaguccgugaucaccuacgagaacaacaccugggugaaccagaccuacgucaacaucagcaacacgaacuucgccgcgggccaguccguggugagcaugaagcuggccgggaacuccagccucugccccgucggcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccgguccccguaccgcacgcugaugagcugccccaucggggaggugcccucccccuacaacagccgguucgaguccguggccuggagcgcgagcgccugccacgacggcaucaacuggcucaccaucggcaucuccgggccggacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggccccuccaacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgcccgugggugagcuucaaccagaaccucgaguaccagaucggcuacaucugcuccgggaucuucggcgacaacccccggcccaacgacaagaccggcagcugcgggcccguguccagcaacggcgccaacggggucaagggcuucuccuucaaguacgggaacggcguguggaucggccgcaccaagagcaucuccagccggaacggguucgagaugaucugggacccgaacggcuggaccgggaccgacaacaacuucagcaucaagcaggacaucgugggcaucaacgagugguccggguacagcggcuccuucguccagcaccccgagcugacgggccuggacugcauccgccccugcuucuggguggagcucauccgggggcgccccaaggagaacaccaucuggaccagcggcuccagcaucuccuucugcggggucaacagcgacaccgugggcugguccuggccggacggcgccgagcugcccuucacgaucgacaaguga

SEQ ID NO: 77910 - RNA, 1410 nt, Artificial Sequence; identical to SEQ ID NO: 77746
  derived and/or modified sequence opt1 from neuraminidase__InfluenzaA__ACR49267

SEQ ID NO: 77911 - RNA, 1410 nt, Artificial Sequence; identical to SEQ ID NO: 77736
  derived and/or modified sequence opt1 from neuraminidase__InfluenzaA__ACR49268

SEQ ID NO: 77912 - RNA, 1410 nt, Artificial Sequence; identical to SEQ ID NO: 77736
  derived and/or modified sequence opt1 from neuraminidase__InfluenzaA__ACR49269

SEQ ID NO: 77913 - RNA, 1410 nt, Artificial Sequence; identical to SEQ ID NO: 77736
  derived and/or modified sequence opt1 from neuraminidase__InfluenzaA__ACR49270

SEQ ID NO: 77914 - RNA, 1410 nt, Artificial Sequence; identical to SEQ ID NO: 77776
  derived and/or modified sequence opt1 from neuraminidase__InfluenzaA__ACR49271

SEQ ID NO: 77915 - RNA, 1410 nt, Artificial Sequence; identical to SEQ ID NO: 77746
  derived and/or modified sequence opt1 from neuraminidase__InfluenzaA__ACR49272

SEQ ID NO: 77916 - RNA, 1410 nt, Artificial Sequence; identical to SEQ ID NO: 77736
  derived and/or modified sequence opt1 from neuraminidase__InfluenzaA__ACR49273

SEQ ID NO: 77917 - RNA, 1410 nt, Artificial Sequence; identical to SEQ ID NO: 77736
  derived and/or modified sequence opt1 from neuraminidase__InfluenzaA__ACR49274

SEQ ID NO: 77918 - RNA, 1410 nt, Artificial Sequence; identical to SEQ ID NO: 77776
  derived and/or modified sequence opt1 from neuraminidase__InfluenzaA__ACR49275

SEQ ID NO: 77919 - RNA, 1410 nt, Artificial Sequence; identical to SEQ ID NO: 77776
  derived and/or modified sequence opt1 from neuraminidase__InfluenzaA__ACR49277

SEQ ID NO: 77920 - RNA, 1410 nt, Artificial Sequence; identical to SEQ ID NO: 77776
  derived and/or modified sequence opt1 from neuraminidase__InfluenzaA__ACR49278

SEQ ID NO: 77921 - RNA, 1410 nt, Artificial Sequence; identical to SEQ ID NO: 77736
  derived and/or modified sequence opt1 from neuraminidase__InfluenzaA__ACR49279

SEQ ID NO: 77922 - RNA, 1410 nt, Artificial Sequence; identical to SEQ ID NO: 77736
  derived and/or modified sequence opt1 from neuraminidase__InfluenzaA__ACR50994

SEQ ID NO: 77923 - RNA, 1410 nt, Artificial Sequence; identical to SEQ ID NO: 77746
  derived and/or modified sequence opt1 from neuraminidase__InfluenzaA__ACR50998

SEQ ID NO: 77924 - RNA, 1410 nt, Artificial Sequence; identical to SEQ ID NO: 77746
  derived and/or modified sequence opt1 from neuraminidase__InfluenzaA__ACR51008

SEQ ID NO: 77925 - RNA, 1410 nt, Artificial Sequence; identical to SEQ ID NO: 77746
  derived and/or modified sequence opt1 from neuraminidase__InfluenzaA__ACR51018

SEQ ID NO: 77926 - RNA, 1410 nt, Artificial Sequence; identical to SEQ ID NO: 77746
  derived and/or modified sequence opt1 from neuraminidase__InfluenzaA__ACR51028

SEQ ID NO: 77927 - RNA, 1410 nt, Artificial Sequence
  derived and/or modified sequence opt1 from neuraminidase__InfluenzaA__ACR51038
augaaccccaaccagaagaucaucaccaucggcagcgugugcauguccaucgggauggccaaccugauccuccagaucggcaacaucaucagcaucuggaucucccacagcauccagcuggggaaccagaaccagaucgagaccugcaaccaguccgucaucacguacgagaacaacaccugggugaaccagaccuacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 77928 - RNA, 1410 nt, Artificial Sequence; identical to SEQ ID NO: 77746
  derived and/or modified sequence opt1 from neuraminidase__InfluenzaA__ACR51048

SEQ ID NO: 77929 - RNA, 1410 nt, Artificial Sequence; identical to SEQ ID NO: 77746
  derived and/or modified sequence opt1 from neuraminidase__InfluenzaA__ACR51058

SEQ ID NO: 77930 - RNA, 1410 nt, Artificial Sequence; identical to SEQ ID NO: 77736
  derived and/or modified sequence opt1 from neuraminidase__InfluenzaA__ACR51068

SEQ ID NO: 77931 - RNA, 1410 nt, Artificial Sequence; identical to SEQ ID NO: 77746
  derived and/or modified sequence opt1 from neuraminidase__InfluenzaA__ACR52371

SEQ ID NO: 77932 - RNA, 1410 nt, Artificial Sequence; identical to SEQ ID NO: 77746
  derived and/or modified sequence opt1 from neuraminidase__InfluenzaA__ACR52381

SEQ ID NO: 77933 - RNA, 1410 nt, Artificial Sequence; identical to SEQ ID NO: 77746
  derived and/or modified sequence opt1 from neuraminidase__InfluenzaA__ACR52391

SEQ ID NO: 77934 - RNA, 1410 nt, Artificial Sequence; identical to SEQ ID NO: 77746
  derived and/or modified sequence opt1 from neuraminidase__InfluenzaA__ACR52401

SEQ ID NO: 77935 - RNA, 1410 nt, Artificial Sequence; identical to SEQ ID NO: 77746
  derived and/or modified sequence opt1 from neuraminidase__InfluenzaA__ACR52411

SEQ ID NO: 77936 - RNA, 1410 nt, Artificial Sequence; identical to SEQ ID NO: 77746
  derived and/or modified sequence opt1 from neuraminidase__InfluenzaA__ACR52421

SEQ ID NO: 77937 - RNA, 1410 nt, Artificial Sequence; identical to SEQ ID NO: 77746
  derived and/or modified sequence opt1 from neuraminidase__InfluenzaA__ACR52431

SEQ ID NO: 77938 - RNA, 1410 nt, Artificial Sequence; identical to SEQ ID NO: 77746
  derived and/or modified sequence opt1 from neuraminidase__InfluenzaA__ACR52441

SEQ ID NO: 77939 - RNA, 1410 nt, Artificial Sequence; identical to SEQ ID NO: 77746
  derived and/or modified sequence opt1 from neuraminidase__InfluenzaA__ACR52451

SEQ ID NO: 77940 - RNA, 1410 nt, Artificial Sequence; identical to SEQ ID NO: 77746
  derived and/or modified sequence opt1 from neuraminidase__InfluenzaA__ACR52471

SEQ ID NO: 77941 - RNA, 1410 nt, Artificial Sequence; identical to SEQ ID NO: 77746
  derived and/or modified sequence opt1 from neuraminidase__InfluenzaA__ACR52481

SEQ ID NO: 77942 - RNA, 1410 nt, Artificial Sequence; identical to SEQ ID NO: 77746
  derived and/or modified sequence opt1 from neuraminidase__InfluenzaA__ACR52491

SEQ ID NO: 77943 - RNA, 1410 nt, Artificial Sequence; identical to SEQ ID NO: 77746
  derived and/or modified sequence opt1 from neuraminidase__InfluenzaA__ACR54046

SEQ ID NO: 77944 - RNA, 1410 nt, Artificial Sequence; identical to SEQ ID NO: 77736
  derived and/or modified sequence opt1 from neuraminidase__InfluenzaA__ACR54052

SEQ ID NO: 77945 - RNA, 1410 nt, Artificial Sequence; identical to SEQ ID NO: 77746
  derived and/or modified sequence opt1 from neuraminidase__InfluenzaA__ACR54966

SEQ ID NO: 77946 - RNA, 1410 nt, Artificial Sequence; identical to SEQ ID NO: 77746
  derived and/or modified sequence opt1 from neuraminidase__InfluenzaA__ACR54976

SEQ ID NO: 77947 - RNA, 1410 nt, Artificial Sequence; identical to SEQ ID NO: 77746
  derived and/or modified sequence opt1 from neuraminidase__InfluenzaA__ACR54986

SEQ ID NO: 77948 - RNA, 1410 nt, Artificial Sequence; identical to SEQ ID NO: 77736
  derived and/or modified sequence opt1 from neuraminidase__InfluenzaA__ACR54996

SEQ ID NO: 77949 - RNA, 1410 nt, Artificial Sequence; identical to SEQ ID NO: 77746
  derived and/or modified sequence opt1 from neuraminidase__InfluenzaA__ACR55006

SEQ ID NO: 77950 - RNA, 1410 nt, Artificial Sequence; identical to SEQ ID NO: 77736
  derived and/or modified sequence opt1 from neuraminidase__InfluenzaA__ACR56383

SEQ ID NO: 77951 - RNA, 1410 nt, Artificial Sequence; identical to SEQ ID NO: 77736
  derived and/or modified sequence opt1 from neuraminidase__InfluenzaA__ACR56393

SEQ ID NO: 77952 - RNA, 1410 nt, Artificial Sequence; identical to SEQ ID NO: 77746
  derived and/or modified sequence opt1 from neuraminidase__InfluenzaA__ACR56403

SEQ ID NO: 77953 - RNA, 1410 nt, Artificial Sequence; identical to SEQ ID NO: 77746
  derived and/or modified sequence opt1 from neuraminidase__InfluenzaA__ACR56413

SEQ ID NO: 77954 - RNA, 1410 nt, Artificial Sequence; identical to SEQ ID NO: 77746
  derived and/or modified sequence opt1 from neuraminidase__InfluenzaA__ACR56423

SEQ ID NO: 77955 - RNA, 1410 nt, Artificial Sequence; identical to SEQ ID NO: 77746
  derived and/or modified sequence opt1 from neuraminidase__InfluenzaA__ACR56433

SEQ ID NO: 77956 - RNA, 1410 nt, Artificial Sequence; identical to SEQ ID NO: 77746
  derived and/or modified sequence opt1 from neuraminidase__InfluenzaA__ACR56443

SEQ ID NO: 77957 - RNA, 1410 nt, Artificial Sequence; identical to SEQ ID NO: 77746
  derived and/or modified sequence opt1 from neuraminidase__InfluenzaA__ACR56453

SEQ ID NO: 77958 - RNA, 1413 nt, Artificial Sequence; identical to SEQ ID NO: 77724
  derived and/or modified sequence opt1 from neuraminidase__InfluenzaA__ACR58555

SEQ ID NO: 77959 - RNA, 1413 nt, Artificial Sequence
  derived and/or modified sequence opt1 from neuraminidase__InfluenzaA__ACR61658
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacguggugaccgggaaggacaagaccuccgucacccuggcgggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcccccagcccguacaacuccaaguucgagagcguggcgugguccgccagcgccugccacgacggcaugggcuggcucacgaucgggaucuccggccccgacaacggggccguggcgguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggagcggguacuccggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 77960 - RNA, 1410 nt, Artificial Sequence
  derived and/or modified sequence opt1 from neuraminidase__InfluenzaA__ACR61680
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaucguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 77961 - RNA, 1410 nt, Artificial Sequence
  derived and/or modified sequence opt1 from neuraminidase__InfluenzaA__ACR61691
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccacaagcuggccgaguaccggaacuggagcaagccccagugcgacaucaccggguucgcgccguucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggacccccuaccgcacccugcucaugaacgagcugggcgugccguuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagacguucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgacaucaaccugaugccgaucuga

SEQ ID NO: 77962 - RNA, 1410 nt, Artificial Sequence
  derived and/or modified sequence opt1 from neuraminidase__InfluenzaA__ACR61702
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcuccaacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 77963 - RNA, 1410 nt, Artificial Sequence; identical to SEQ ID NO: 77736
  derived and/or modified sequence opt1 from neuraminidase__InfluenzaA__ACR67201

SEQ ID NO: 77964 - RNA, 1410 nt, Artificial Sequence; identical to SEQ ID NO: 77746
  derived and/or modified sequence opt1 from neuraminidase__InfluenzaA__ACR67202

SEQ ID NO: 77965 - RNA, 1410 nt, Artificial Sequence; identical to SEQ ID NO: 77736
  derived and/or modified sequence opt1 from neuraminidase__InfluenzaA__ACR67203

SEQ ID NO: 77966 - RNA, 1410 nt, Artificial Sequence; identical to SEQ ID NO: 77746
  derived and/or modified sequence opt1 from neuraminidase__InfluenzaA__ACR67204

SEQ ID NO: 77967 - RNA, 1410 nt, Artificial Sequence; identical to SEQ ID NO: 77746
  derived and/or modified sequence opt1 from neuraminidase__InfluenzaA__ACR67246

SEQ ID NO: 77968 - RNA, 1410 nt, Artificial Sequence; identical to SEQ ID NO: 77736
  derived and/or modified sequence opt1 from neuraminidase__InfluenzaA__ACR67256

SEQ ID NO: 77969 - RNA, 1410 nt, Artificial Sequence; identical to SEQ ID NO: 77746
  derived and/or modified sequence opt1 from neuraminidase__InfluenzaA__ACR77451

SEQ ID NO: 77970 - RNA, 1410 nt, Artificial Sequence; identical to SEQ ID NO: 77746
  derived and/or modified sequence opt1 from neuraminidase__InfluenzaA__ACR77461

SEQ ID NO: 77971 - RNA, 1410 nt, Artificial Sequence; identical to SEQ ID NO: 77746
  derived and/or modified sequence opt1 from neuraminidase__InfluenzaA__ACR77471

SEQ ID NO: 77972 - RNA, 1410 nt, Artificial Sequence; identical to SEQ ID NO: 77746
  derived and/or modified sequence opt1 from neuraminidase__InfluenzaA__ACR77481

SEQ ID NO: 77973 - RNA, 1410 nt, Artificial Sequence; identical to SEQ ID NO: 77746
  derived and/or modified sequence opt1 from neuraminidase__InfluenzaA__ACR77491

SEQ ID NO: 77974 - RNA, 1410 nt, Artificial Sequence; identical to SEQ ID NO: 77746
  derived and/or modified sequence opt1 from neuraminidase__InfluenzaA__ACR77501

SEQ ID NO: 77975 - RNA, 1410 nt, Artificial Sequence; identical to SEQ ID NO: 77746
  derived and/or modified sequence opt1 from neuraminidase__InfluenzaA__ACR83527

SEQ ID NO: 77976 - RNA, 1410 nt, Artificial Sequence; identical to SEQ ID NO: 77746
  derived and/or modified sequence opt1 from neuraminidase__InfluenzaA__ACR83539

SEQ ID NO: 77977 - RNA, 1410 nt, Artificial Sequence; identical to SEQ ID NO: 77746
  derived and/or modified sequence opt1 from neuraminidase__InfluenzaA__ACS14669

SEQ ID NO: 77978 - RNA, 1410 nt, Artificial Sequence; identical to SEQ ID NO: 77746
  derived and/or modified sequence opt1 from neuraminidase__InfluenzaA__ACS14679

SEQ ID NO: 77979 - RNA, 1410 nt, Artificial Sequence; identical to SEQ ID NO: 77746
  derived and/or modified sequence opt1 from neuraminidase__InfluenzaA__ACS14689

SEQ ID NO: 77980 - RNA, 1410 nt, Artificial Sequence; identical to SEQ ID NO: 77746
  derived and/or modified sequence opt1 from neuraminidase__InfluenzaA__ACS14699

SEQ ID NO: 77981 - RNA, 1410 nt, Artificial Sequence; identical to SEQ ID NO: 77746
  derived and/or modified sequence opt1 from neuraminidase__InfluenzaA__ACS14709

SEQ ID NO: 77982 - RNA, 1410 nt, Artificial Sequence; identical to SEQ ID NO: 77746
  derived and/or modified sequence opt1 from neuraminidase__InfluenzaA__ACS14719

SEQ ID NO: 77983 - RNA, 1410 nt, Artificial Sequence; identical to SEQ ID NO: 77746
  derived and/or modified sequence opt1 from neuraminidase__InfluenzaA__ACS14729

SEQ ID NO: 77984 - RNA, 1410 nt, Artificial Sequence; identical to SEQ ID NO: 77746
  derived and/or modified sequence opt1 from neuraminidase__InfluenzaA__ACS14739

SEQ ID NO: 77985 - RNA, 1410 nt, Artificial Sequence; identical to SEQ ID NO: 77736
  derived and/or modified sequence opt1 from neuraminidase__InfluenzaA__ACS27192

SEQ ID NO: 77986 - RNA, 1410 nt, Artificial Sequence; identical to SEQ ID NO: 77746
  derived and/or modified sequence opt1 from neuraminidase__InfluenzaA__ACS27202

SEQ ID NO: 77987 - RNA, 1410 nt, Artificial Sequence; identical to SEQ ID NO: 77746
  derived and/or modified sequence opt1 from neuraminidase__InfluenzaA__ACS27212

SEQ ID NO: 77988 - RNA, 1410 nt, Artificial Sequence; identical to SEQ ID NO: 77736
  derived and/or modified sequence opt1 from neuraminidase__InfluenzaA__ACS27222

SEQ ID NO: 77989 - RNA, 1410 nt, Artificial Sequence; identical to SEQ ID NO: 77746
  derived and/or modified sequence opt1 from neuraminidase__InfluenzaA__ACS27232

SEQ ID NO: 77990 - RNA, 1410 nt, Artificial Sequence; identical to SEQ ID NO: 77736
  derived and/or modified sequence opt1 from neuraminidase__InfluenzaA__ACS27242

SEQ ID NO: 77991 - RNA, 1410 nt, Artificial Sequence; identical to SEQ ID NO: 77746
  derived and/or modified sequence opt1 from neuraminidase__InfluenzaA__ACS27252

SEQ ID NO: 77992 - RNA, 1410 nt, Artificial Sequence; identical to SEQ ID NO: 77736
  derived and/or modified sequence opt1 from neuraminidase__InfluenzaA__ACS27771

SEQ ID NO: 77993 - RNA, 1410 nt, Artificial Sequence; identical to SEQ ID NO: 77901
  derived and/or modified sequence opt1 from neuraminidase__InfluenzaA__ACS34969

SEQ ID NO: 77994 - RNA, 1410 nt, Artificial Sequence; identical to SEQ ID NO: 77901
  derived and/or modified sequence opt1 from neuraminidase__InfluenzaA__ACS34970

SEQ ID NO: 77995 - RNA, 1410 nt, Artificial Sequence; identical to SEQ ID NO: 77901
  derived and/or modified sequence opt1 from neuraminidase__InfluenzaA__ACS34971

SEQ ID NO: 77996 - RNA, 1410 nt, Artificial Sequence; identical to SEQ ID NO: 77746
  derived and/or modified sequence opt1 from neuraminidase__InfluenzaA__ACS34972

SEQ ID NO: 77997 - RNA, 1410 nt, Artificial Sequence; identical to SEQ ID NO: 77746
  derived and/or modified sequence opt1 from neuraminidase__InfluenzaA__ACS50081

SEQ ID NO: 77998 - RNA, 1410 nt, Artificial Sequence; identical to SEQ ID NO: 77746
  derived and/or modified sequence opt1 from neuraminidase__InfluenzaA__ACS50087

SEQ ID NO: 77999 - RNA, 1410 nt, Artificial Sequence; identical to SEQ ID NO: 77746
  derived and/or modified sequence opt1 from neuraminidase__InfluenzaA__ACS50094

SEQ ID NO: 78000 - RNA, 1410 nt, Artificial Sequence; identical to SEQ ID NO: 77736
  derived and/or modified sequence opt1 from neuraminidase__InfluenzaA__ACS54264

SEQ ID NO: 78001 - RNA, 1410 nt, Artificial Sequence; identical to SEQ ID NO: 77901
  derived and/or modified sequence opt1 from neuraminidase__InfluenzaA__ACS54265

SEQ ID NO: 78002 - RNA, 1410 nt, Artificial Sequence; identical to SEQ ID NO: 77746
  derived and/or modified sequence opt1 from neuraminidase__InfluenzaA__ACS54266

SEQ ID NO: 78003 - RNA, 1410 nt, Artificial Sequence; identical to SEQ ID NO: 77746
  derived and/or modified sequence opt1 from neuraminidase__InfluenzaA__ACS54267

SEQ ID NO: 78004 - RNA, 1410 nt, Artificial Sequence; identical to SEQ ID NO: 77746
  derived and/or modified sequence opt1 from neuraminidase__InfluenzaA__ACS54268

SEQ ID NO: 78005 - RNA, 1410 nt, Artificial Sequence; identical to SEQ ID NO: 77746
  derived and/or modified sequence opt1 from neuraminidase__InfluenzaA__ACS54303

SEQ ID NO: 78006 - RNA, 1410 nt, Artificial Sequence; identical to SEQ ID NO: 77746
  derived and/or modified sequence opt1 from neuraminidase__InfluenzaA__ACS68823

SEQ ID NO: 78007 - RNA, 1410 nt, Artificial Sequence; identical to SEQ ID NO: 77746
  derived and/or modified sequence opt1 from neuraminidase__InfluenzaA__ACS75824

SEQ ID NO: 78008 - RNA, 1410 nt, Artificial Sequence; identical to SEQ ID NO: 77746
  derived and/or modified sequence opt1 from neuraminidase__InfluenzaA__ACS77929

SEQ ID NO: 78009 - RNA, 1410 nt, Artificial Sequence; identical to SEQ ID NO: 77746
  derived and/or modified sequence opt1 from neuraminidase__InfluenzaA__ACS77939

SEQ ID NO: 78010 - RNA, 1410 nt, Artificial Sequence; identical to SEQ ID NO: 77736
  derived and/or modified sequence opt1 from neuraminidase__InfluenzaA__ACS77949

SEQ ID NO: 78011 - RNA, 1410 nt, Artificial Sequence; identical to SEQ ID NO: 77746
  derived and/or modified sequence opt1 from neuraminidase__InfluenzaA__ACS77959

SEQ ID NO: 78012 - RNA, 1410 nt, Artificial Sequence; identical to SEQ ID NO: 77746
  derived and/or modified sequence opt1 from neuraminidase__InfluenzaA__ACS77969

SEQ ID NO: 78013 - RNA, 1410 nt, Artificial Sequence; identical to SEQ ID NO: 77746
  derived and/or modified sequence opt1 from neuraminidase__InfluenzaA__ACS77979

SEQ ID NO: 78014 - RNA, 1410 nt, Artificial Sequence; identical to SEQ ID NO: 77746
  derived and/or modified sequence opt1 from neuraminidase__InfluenzaA__ACS77989

SEQ ID NO: 78015 - RNA, 1410 nt, Artificial Sequence; identical to SEQ ID NO: 77746
  derived and/or modified sequence opt1 from neuraminidase__InfluenzaA__ACS77999

SEQ ID NO: 78016 - RNA, 1410 nt, Artificial Sequence; identical to SEQ ID NO: 77746
  derived and/or modified sequence opt1 from neuraminidase__InfluenzaA__ACS78009

SEQ ID NO: 78017 - RNA, 1410 nt, Artificial Sequence; identical to SEQ ID NO: 77746
  derived and/or modified sequence opt1 from neuraminidase__InfluenzaA__ACS78019

SEQ ID NO: 78018 - RNA, 1410 nt, Artificial Sequence; identical to SEQ ID NO: 77746
  derived and/or modified sequence opt1 from neuraminidase__InfluenzaA__ACS78039

SEQ ID NO: 78019 - RNA, 1410 nt, Artificial Sequence; identical to SEQ ID NO: 77746
  derived and/or modified sequence opt1 from neuraminidase__InfluenzaA__ACS78049

SEQ ID NO: 78020 - RNA, 1410 nt, Artificial Sequence; identical to SEQ ID NO: 77746
  derived and/or modified sequence opt1 from neuraminidase__InfluenzaA__ACS88274

SEQ ID NO: 78021 - RNA, 1410 nt, Artificial Sequence; identical to SEQ ID NO: 77746
  derived and/or modified sequence opt1 from neuraminidase__InfluenzaA__ACS88275

SEQ ID NO: 78022 - RNA, 1410 nt, Artificial Sequence; identical to SEQ ID NO: 77736
  derived and/or modified sequence opt1 from neuraminidase__InfluenzaA__ACS92572

SEQ ID NO: 78023 - RNA, 1410 nt, Artificial Sequence; identical to SEQ ID NO: 77736
  derived and/or modified sequence opt1 from neuraminidase__InfluenzaA__ACS92582

SEQ ID NO: 78024 - RNA, 1410 nt, Artificial Sequence; identical to SEQ ID NO: 77746
  derived and/or modified sequence opt1 from neuraminidase__InfluenzaA__ACS92592

SEQ ID NO: 78025 - RNA, 1410 nt, Artificial Sequence; identical to SEQ ID NO: 77746
  derived and/or modified sequence opt1 from neuraminidase__InfluenzaA__ACS92603

SEQ ID NO: 78026 - RNA, 1410 nt, Artificial Sequence; identical to SEQ ID NO: 77736
  derived and/or modified sequence opt1 from neuraminidase__InfluenzaA__ACS92614

SEQ ID NO: 78027 - RNA, 1410 nt, Artificial Sequence; identical to SEQ ID NO: 77746
  derived and/or modified sequence opt1 from neuraminidase__InfluenzaA__ACT09115

SEQ ID NO: 78028 - RNA, 1410 nt, Artificial Sequence; identical to SEQ ID NO: 77746
  derived and/or modified sequence opt1 from neuraminidase__InfluenzaA__ACT10309

SEQ ID NO: 78029 - RNA, 1410 nt, Artificial Sequence; identical to SEQ ID NO: 77746
  derived and/or modified sequence opt1 from neuraminidase__InfluenzaA__ACT10315

SEQ ID NO: 78030 - RNA, 1410 nt, Artificial Sequence; identical to SEQ ID NO: 77736
  derived and/or modified sequence opt1 from neuraminidase__InfluenzaA__ACT11059

SEQ ID NO: 78031 - RNA, 1350 nt, Artificial Sequence
  derived and/or modified sequence opt1 from neuraminidase__InfluenzaA__ACT15313
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccugggucuccuucaaccagaaccucgaguaccagaucggguacaucugcagcggcguguucggggacaacccgcggcccaacgacggcaccggcuccugcgggcccguguuccccaacggcgccuacggggucaagggcuucagcuucaaguacgggaacggcguguggaucggccgcaccaaguccaccaacagccgguccggguucgagaugaucugggacccgaacggcuggaccgggaccgacagcagcuucuccgugaagcaggacaucgucgcgaucacggacuggagcggcuacuccgggagcuucgugcagcaccccgagcugaccggccuggacugcauccgccccugcuucugggucgagcucauccggggccgccccaaggaguccaccaucuggaccagcggguccagcaucuccuucugcggcgugaacggggacacggugagcugguccuggccggacggcgccgagcugcccuucaccaucgacaaguga

SEQ ID NO: 78032 - RNA, 1350 nt, Artificial Sequence
  derived and/or modified sequence opt1 from neuraminidase__InfluenzaA__ACT15315
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucaugcgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccugggucuccuucaaccagaaccucgaguaccagaucggguacaucugcagcggcguguucggggacaacccgcggcccaacgacggcaccggcuccugcgggcccguguuccccaacggcgccuacggggucaagggcuucagcuucaaguacgggaacggcguguggaucggccgcaccaaguccaccaacagccgguccggguucgagaugaucugggacccgaacggcuggaccgggaccgacagcagcuucuccgugaagcaggacaucgucgcgaucacggacuggagcggcuacuccgggagcuucgugcagcaccccgagcugaccggccuggacugcauccgccccugcuucugggucgagcucauccggggccgccccaaggaguccaccaucuggaccagcggguccagcaucuccuucugcggcgugaacggggacacggugagcugguccuggccggacggcgccgagcugcccuucaccaucgacaaguga

SEQ ID NO: 78033 - RNA, 1350 nt, Artificial Sequence; identical to SEQ ID NO: 78031
  derived and/or modified sequence opt1 from neuraminidase__InfluenzaA__ACT15319

SEQ ID NO: 78034 - RNA, 1350 nt, Artificial Sequence
  derived and/or modified sequence opt1 from neuraminidase__InfluenzaA__ACT15321
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagcgcgccguggccagcgucacccuggcgggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacaucaugcggacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccucgaguaccagaucggguacaucugcagcggcguguucggggacaacccgcgccccaacgacggcaccggcuccugcgggcccguguuccccaacggcgccuacggggucaagggcuucagcuucaaguacgggaacggcguguggaucggccggaccaaguccaccaacagccgcuccggguucgagaugaucugggacccgaacggcuggaccgggaccgacagcagcuucuccgugaagcaggacaucgucgcgaucacggacuggagcggcuacuccgggagcuucgugcagcaccccgagcugaccggccuggacugcauccggcccugcuucugggucgagcucauccgcggccggcccaaggaguccaccaucuggaccagcggguccagcaucuccuucugcggcgugaacggggacacggugagcugguccuggccggacggcgccgagcugcccuucaccaucgacaaguga

SEQ ID NO: 78035 - RNA, 1350 nt, Artificial Sequence; identical to SEQ ID NO: 78031
  derived and/or modified sequence opt1 from neuraminidase__InfluenzaA__ACT15323

SEQ ID NO: 78036 - RNA, 1350 nt, Artificial Sequence; identical to SEQ ID NO: 78031
  derived and/or modified sequence opt1 from neuraminidase__InfluenzaA__ACT15325

SEQ ID NO: 78037 - RNA, 1350 nt, Artificial Sequence
  derived and/or modified sequence opt1 from neuraminidase__InfluenzaA__ACT15327
augaaccccaaccagaagaucaucaccaucggcagcaucugcauggugaucgggaucgucucccugaugcuccagaucggcaacaugaucagcaucugggugucccacagcauccagaccgggaaccgcugccaggacgagccgaucuccaacacgaaguuccugaccgagaaggccguggccagcgucacccuggcgggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacaucaugcggacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccucgaguacaagaucggguacaucugcagcggcaucuucggggacaacccgcgccccaacgacggcaccggcuccugcgggcccguguuccccaacggcgccuacggggugaagggcuucagcuucaaguacgggaacggcgucuggaucggccggaccaaguccaccaacagccgcuccggguucgagaugaucugggacccgaacggcuggaccgggaccgacagcagcuucuccgugaagcaggacaucguggcgaucacggacuggagcggcuacuccgggagcuucguccagcaccccgagcugaccggccuggacugcauccggcccugcuucuggguggagcucauccgcggccggcccaaggaguccaccaucuggaccagcggguccagcaucuccuucugcggcgucaacggggacacggugagcugguccuggccggacggcgccgagcugcccuucaccaucgacaaguga

SEQ ID NO: 78038 - RNA, 1350 nt, Artificial Sequence
  derived and/or modified sequence opt1 from neuraminidase__InfluenzaA__ACT15331
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccugggucuccuucaaccagaaccucgaguaccagaucggguacaucugcagcggcguguucggggacaacccgcggcccaacgacggcaccggcuccugcgggcccguguuccccaacggcgccuacggggucaagggcuucagcuucaaguacgggaacggcguguggaucggccgcaccaaguccaccaacagccgguccggguucgagaugaucugggacccgaacggcuggaccgggaccgacagcagcuucuccgugaagcaggacaucgucgcgaucacggacuggagcggcuacuccgggagcuucgugcagcaccccgagcugaccggccuggacugcauccgccccugcuucugggucgagcucauccggggccgccccaaggaguccaccaucuggaccagcggguccagcaucuccuucugcggcgugaacagcgacacgguguccuggagcuggccggacggggccgagcugcccuucaccaucgacaaguga

SEQ ID NO: 78039 - RNA, 1350 nt, Artificial Sequence
  derived and/or modified sequence opt1 from neuraminidase__InfluenzaA__ACT15333
augaaccccaaccagaagaucaucaccaucggcagcaucugcauggugaucgggaucgucucccugaugcuccagaucggcaacaugaucagcaucugggugucccacagcauccagaccgggaaccagugccagggcgagccgaucuccaacacgaaguuccugaccgagaaggccguggccagcgucacccuggcggggaacuccagccucugccccaucuccggcugggccguguacagcaaggacaacuccauccgcaucggcagccgcggggacguguucgucauccgggagcccuucaucuccugcagccaccuggagugccggaccuucuuccugacgcagggcgcccuccugaacgacaagcacuccaacgggaccgugaaggaccgcagcccccaccggacccugauguccugcccggugggcgaggcccccagccccuacaacucccgcuucgagagcgucgccuggagcgcguccgccugccacgacgggaccagcuggcucacgaucggcaucuccggccccgacaacggggccguggccgugcugaaguacaacggcaucaucaccgacaccaucaagagcuggcggaacaacauccugcgcacccaggaguccgagugcgcgugcgucaacgggagcugcuucacggugaugaccgacggcccguccagcggccaggccuccuacaagaucuucaagauggagaaggggaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacggcaccggguccugcggccccguggucagcaacggggccuacggcgugaagggguucuccuucaaguacggcaacggcguguggaucgggcgcaccaagagcaccaacucccggagcggcuucgagaugaucugggaccccaacggguggaccggcaccgacagcuccuucagcgggaagcaggacaucgucgcgaucacggacugguccggcuacagcggcuccuucgugcagcacccggagcugaccgggcucgacugcauccgccccugcuucugggucgagcugauccggggccgccccaaggagagcaccaucuggaccuccgggagcuccaucagcuucugcggcgugaacuccgacacggugagcugguccuggcccgacggcgccgagcugccguucaccaucgacaaguga

SEQ ID NO: 78040 - RNA, 1350 nt, Artificial Sequence
  derived and/or modified sequence opt1 from neuraminidase__InfluenzaA__ACT15335
augaaccccaaccagaagaucaucaccaucggcagcaucugcauggugaucgggaucgucucccugaugcuccagaucggcaacaugaucagcaucugggugucccacagcauccagaccgggaaccgcugccaggacgagccgaucuccaacacgaaguuccugaccgagaaggccguggccagcgucacccuggcgggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacaucaugcggacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccucgaguacaagaucggguacaucugcagcggcaucuucggggacaacccgcgccccaacgacggcaccggcuccugcgggcccgugcugcccaacggcgccuacggggugaagggcuucagcuucaaguacgggaacggcgucuggaucggccggaccaaguccaccaacagccgcuccggguucgagaugaucugggacccgaacggcuggaccgggaccgacagcagcuucuccgugaagcaggacaucguggcgaucacggacuggagcggcuacuccgggagcuucguccagcaccccgagcugaccggccucgacugcauccggcccugcuucuggguggagcugauccgcggccggcccaaggaguccaccaucuggaccagcggguccagcaucuccuucugcggcgucaacggggacacggugagcugguccuggccggacggcgccgagcugcccuucaccaucgacaaguga

SEQ ID NO: 78041 - RNA, 1350 nt, Artificial Sequence
  derived and/or modified sequence opt1 from neuraminidase__InfluenzaA__ACT15337
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccugggucuccuucaaccagaaccucgaguaccagaucggguacaucugcagcggcguguucggggacaacccgcggcccaacgacggcaccggcuccugcgggcccguguuccccaacggcgccuacggggucaagggcuucagcuucaaguacgggaacggcguguggaucggccgcaccaaguccaccaacagccgguccggguucgagaugaucugggacccgaacggcuggaccgggaccgacagcagcuucuccgugaagcaggacaucgucgcggugacggacuggagcggcuacuccgggagcuucguccagcaccccgagcugaccggccuggacugcauccgccccugcuucuggguggagcucauccggggccgccccaaggaguccaccaucuggaccagcggguccagcaucuccuucugcggcgugaacggggacacggucagcugguccuggccggacggcgccgagcugcccuucaccaucgacaaguga

SEQ ID NO: 78042 - RNA, 1350 nt, Artificial Sequence; identical to SEQ ID NO: 78031
  derived and/or modified sequence opt1 from neuraminidase__InfluenzaA__ACT15341

SEQ ID NO: 78043 - RNA, 1350 nt, Artificial Sequence
  derived and/or modified sequence opt1 from neuraminidase__InfluenzaA__ACT15344
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgguccaacaucaugcgcacccaggagagcgagugcgcgugcgucaacggcuccugcuucacggugaugaccgacgggccgagcuccggccaggccagcuacaagaucuucaagauggagaagggcaagguggucaaguccguggagcuggacgcccccaacuaccacuacgaggagugcagcugcuaccccgacgccggggagaucacgugcgugugccgggacaacuggcacggcuccaaccgccccugggucagcuucaaccagaaccucgaguaccagaucggguacaucugcuccggcguguucggggacaacccgcggcccaacgacggcaccggcagcugcgggcccguguuccccaacggcgccuacggggucaagggcuucuccuucaaguacgggaacggcguguggaucggccgcaccaagagcaccaacucccggagcggguucgagaugaucugggacccgaacggcuggaccgggaccgacagcuccuucagcgugaagcaggacaucgucgcgaucacggacugguccggcuacagcggguccuucgugcagcaccccgagcugaccggccuggacugcauccgccccugcuucugggucgagcucauccggggccgccccaaggagagcaccaucuggaccuccgggagcuccaucagcuucugcggcgugaacggggacacgguguccuggagcuggccggacggcgccgagcugcccuucaccaucgacaaguga

SEQ ID NO: 78044 - RNA, 1350 nt, Artificial Sequence
  derived and/or modified sequence opt1 from neuraminidase__InfluenzaA__ACT15346
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacaacauccgcaucggcucccggggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgccuggagcgcgagcgccugccacgacggcaccuccuggcucacgaucgggaucagcggccccgacaacggcgccguggccgugcugaaguacaacgggaucaucaccgacaccaucaaguccuggcggaacaacaucaugcgcacccaggagagcgagugcgcgugcgucaacggcuccugcuucacggugaugaccgacgggccgagcuccggccaggccagcuacaagaucuucaagauggagaagggcaagguggucaaguccguggagcuggacgcccccaacuaccacuacgaggagugcagcugcuaccccgacgccggggagaucacgugcgugugccgggacaacuggcacggcuccaaccgccccugggucagcuucaaccagaaccucgaguaccagaucggguacaucugcuccggcguguucggggacaacccgcggcccaacgacggcaccggcagcugcgggcccguguuccccaacggcgccuacggggucaagggcuucuccuucaaguacgggaacggcguguggaucggccgcaccaagagcaccaacucccggagcggguucgagaugaucugggacccgaacggcuggaccgggaccgacuccagcuucagcgugaagcaggacaucgucgcgaucacggacugguccggcuacagcggguccuucgugcagcaccccgagcugaccggccuggacugcauccgccccugcuucugggucgagcucauccggggccgccccaaggagagcaccaucuggaccuccgggagcuccaucagcuucugcggcgugaacggggacacgguguccuggagcuggccggacggcgccgagcugcccuucaccaucgacaaguga

SEQ ID NO: 78045 - RNA, 1350 nt, Artificial Sequence
  derived and/or modified sequence opt1 from neuraminidase__InfluenzaA__ACT15348
augaaccccaaccagaagaucaucaccaucggcagcaucugcauggugaucgggaccgucucccugaugcuccagaucggcaacaugaucagcaucugggugucccacagcauccagacggggaaccagugccagggcgagccgaucuccaacaccaaguuccugaccgagaaggccguggccagcgucacccuggcggggaacuccagccucugccccaucuccggcugggccguguacagcaaggacaacuccauccgcaucggcagccgcggggacguguucgucauccgggagcccuucaucuccugcagccaccuggagugccggacguucuuccugacccagggcgcccuccugaacgacaagcacuccaacgggaccgugaaggaccgcagcccccaccggacccugauguccugcccggugggcgaggcccccagccccuacaacucccgcuucgagagcgucgccuggagcgcguccgccugccacgacgggacgagcuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccagcggccaggccuccuacaagaucuucaagauggagaaggggaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacggcaccggguccugcggccccguggucagcaacggggccuacggcgugaagggguucuccuucaaguacggcaacggcguguggaucgggcgcaccaagagcaccaacucccggagcggcuucgagaugaucugggaccccaacggguggaccggcacggacagcuccuucagcgggaagcaggacaucgucgcgaucaccgacugguccggcuacagcggcuccuucgugcagcacccggagcugaccgggcucgacugcauccgccccugcuucugggucgagcugauccggggccgccccaaggagagcaccaucuggacguccgggagcuccaucagcuucugcggcgugaacuccgacaccgugagcugguccuggcccgacggcgccgagcugccguucaccaucgacaaguga

SEQ ID NO: 78046 - RNA, 1350 nt, Artificial Sequence
  derived and/or modified sequence opt1 from neuraminidase__InfluenzaA__ACT15350
augaaccccaaccagaagaucaucaccaucggcagcaucugcauggugaucgggaucgucucccugaugcuccagaucggcaacaugaucagcaucugggugucccacagcauccagaccgggaaccgcugccaggacgagccgaucuccaacacgaaguuccugaccgagaaggccguggccagcgucacccuggcgggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacaucaugcggacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccucgaguacaagaucggguacaucugcagcggcaucuucggggacaacccgcgccccaacgacggcaccggcuccugcgggcccguguuccccaacggcgccuacggggugaagggcuucagcuucaaguacgggaacggcgucuggaucggccggaccaaguccaccaacagccgcuccggguucgagaugaucugggacccgaacggcuggaccgggaccgacagcagcuucuccgugaagcaggacaucguggcgaucacggacuggagcggcuacuccgggagcuucguccagcaccccgagcugaccggccuggacugcauccggcccugcuucuggguggagcucauccgcggccggcccaaggagcgcaccaucuggaccuccgggagcuccaucagcuucugcggcgucaacggggacacgguguccuggagcuggccggacggcgccgagcugcccuucaccaucgacaaguga

SEQ ID NO: 78047 - RNA, 1350 nt, Artificial Sequence
  derived and/or modified sequence opt1 from neuraminidase__InfluenzaA__ACT15352
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacauccugcgcacccaggaguccgagugcgcgugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccguggucagcaacggcgccuacggggugaagggcuucuccuucaaguacgggaacggcguguggaucggccgcaccaagagcaccaacucccggagcggguucgagaugaucugggaccccaacggcuggaccgggaccgacagcuccuucagcggcaagcaggacaucgucgcgaucacggacugguccggguacagcggcuccuucgugcagcacccggagcugaccggccucgacugcauccgccccugcuucugggucgagcugauccgggggcgccccaaggagagcaccaucuggaccuccggcagcuccaucagcuucugcggggugaacuccgacacggugagcugguccuggcccgacggcgccgagcugccguucaccaucgacaaguga

SEQ ID NO: 78048 - RNA, 1350 nt, Artificial Sequence
  derived and/or modified sequence opt1 from neuraminidase__InfluenzaA__ACT15354
augaaccccagccagaagaucaucaccaucggcuccaucugcauggugaucgggaucgucagccugaugcuccagaucggcaacaugaucuccaucuggaucagccacuccauccagaccgggaaccagugccaggacgagccgaucagcaacacgaaguuccugaccgagaaggccguggccuccgugacccuggcgggcaacagcucccucugccccaucagcgggugggccgucuacuccaaggacaacagcauccgcaucggcucccggggcgacguguucgugauccgcgagcccuucaucagcugcucccaccuggagugccggaccuucuuccugacgcagggggcccuccugaacgacaagcacagcaacggcaccgucaaggaccgcagcccccaccggacccugauguccugcccggugggggaggcccccucccccuacaacagccgcuucgagagcguggccugguccgcgagcgccugccacgacggcaccuccuggcucacgaucgggaucagcggccccgacaacggcgccgucgccgugcugaaguacaacgggaucaucaccgacaccaucaaguccuggcggaacaacaucaugcgcacccaggagagcgagugcgcgugcgugaacggcuccugcuucacggucaugaccgacgggccgagcuccggccaggccagcuacaagaucuucaagauggagaagggcaagguggugaaguccgucgagcuggacgcccccaacuaccacuacgaggagugcagcugcuaccccgacgccggggagaucacgugcgugugccgggacaacuggcacggcuccaaccgccccugggugagcuucaaccagaaccucgaguaccagaucggguacaucugcuccggcgucuucggggacaacccgcggcccaacgacggcaccggcagcugcgggcccguguuccccaacggcgccuacggggugaagggcuucuccuucaaguacgggaacggcgucuggaucggccgcaccaagagcaccaacucccggagcggguucgagaugaucugggacccgaacggcuggaccgggaccgacagcuccuucagcgugaagcaggacaucguggcgaucacggacugguccggcuacagcggguccuucguccagcaccccgagcugaccggccuggacugcauccgccccugcuucuggguggagcucauccggggccgccccaaggagagcaccaucuggaccuccgggagcuccaucagcuucugcggcgucaacggggacacgguguccuggagcuggccggacggcgccgagcugcccuucaccaucgacaaguga

SEQ ID NO: 78049 - RNA, 1350 nt, Artificial Sequence
  derived and/or modified sequence opt1 from neuraminidase__InfluenzaA__ACT15356
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacauccugcgcacccaggaguccgagugcgcgugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccguguucagcaacggcgccuacggggucaagggcuucuccuucaaguacgggaacggcguguggaucggccgcaccaagagcaccaacucccggagcggguucgagaugaucugggaccccaacggcuggaccgggaccgacagcuccuucagcggcaagcaggacaucguggcgaucacggacugguccggguacagcggcuccuucguccagcacccggagcugaccggccucgacugcauccgccccugcuucuggguggagcugauccgggggcgccccaaggagagcaccaucuggaccuccggcagcuccaucagcuucugcggggucaacuccgacacggugagcugguccuggcccgacggcgccgagcugccguucaccaucgacaaguga

SEQ ID NO: 78050 - RNA, 1350 nt, Artificial Sequence
  derived and/or modified sequence opt1 from neuraminidase__InfluenzaA__ACT15358
augaaccccaaccagaagaucaucaccaucggcagcaucugcauggugaucgggaucgucucccugaugcuccagaucggcaacaugaucagcaucugggugucccacagcauccagaccgggaaccgcugccaggacgagccgaucuccaacacgaaguuccugaccgagaaggccguggccagcgucacccuggcgggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcacggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacaucaugcggacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccuggaucuccuucaaccagaaccucgaguacaagaucggguacaucugcagcggcaucuucggggacaacccgcgccccaacgacggcaccggcuccugcgggcccguccugcccaacggcgccuacggggugaagggcuucagcuucaaguacgggaacggcguguggaucggccggaccaaguccaccaacagccgcuccggguucgagaugaucugggacccgaacggcuggaccgggaccgacagcagcuucuccgucaagcaggacaucguggcgaucacggacuggagcggcuacuccgggagcuucgugcagcaccccgagcugaccggccucgacugcauccggcccugcuucugggucgagcugauccgcggccggcccaaggaguccaccaucuggaccagcggguccagcaucuccuucugcggcgugaacggggacacggucagcugguccuggccggacggcgccgagcugcccuucaccaucgacaaguga

SEQ ID NO: 78051 - RNA, 1410 nt, Artificial Sequence; identical to SEQ ID NO: 75335
  derived and/or modified sequence opt1 from neuraminidase__InfluenzaA__ACT21515

SEQ ID NO: 78052 - RNA, 1410 nt, Artificial Sequence
  derived and/or modified sequence opt1 from neuraminidase__InfluenzaA__ACT21516
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucgccuaccucaccaacaccacgaucgagaaggagaucugccccaagcuggcggaguaccggaacuggagcaagccgcagugcgacaucaccggguucgcccccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcguggccuggagcuccagcuccugccacgacgggaaggcguggcuccacgugugcgugaccggcgacgagaagaacgccaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggcggacaccaagauccucuucaucgaggagggcaagaucgugcacacgagcacccuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaacgaggugcuguggaccuccaacagcaucgucguguucugcggcaccuccgggaccuacggcacggggagcuggccggacggcgccgacaucaaccugaugcccaucuga

SEQ ID NO: 78053 - RNA, 1410 nt, Artificial Sequence
  derived and/or modified sequence opt1 from neuraminidase__InfluenzaA__ACT21517
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcgagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccuggugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucgucgacuccaucgugagcugguccaaggagauccugcggacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggccggcgacacgccccgcaagaacgacuccagcuccagcucccacugccuggaccccaacaacgaggagggcgggcacggggucaagggcugggccuucgacgacgggaacgacguguggaugggccggaccaucagcgagaagcuccgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 78054 - RNA, 1410 nt, Artificial Sequence; identical to SEQ ID NO: 77746
  derived and/or modified sequence opt1 from neuraminidase__InfluenzaA__ACT21574

SEQ ID NO: 78055 - RNA, 1410 nt, Artificial Sequence; identical to SEQ ID NO: 77746
  derived and/or modified sequence opt1 from neuraminidase__InfluenzaA__ACT21585

SEQ ID NO: 78056 - RNA, 1410 nt, Artificial Sequence; identical to SEQ ID NO: 77746
  derived and/or modified sequence opt1 from neuraminidase__InfluenzaA__ACT22011

SEQ ID NO: 78057 - RNA, 1410 nt, Artificial Sequence; identical to SEQ ID NO: 77746
  derived and/or modified sequence opt1 from neuraminidase__InfluenzaA__ACT22012

SEQ ID NO: 78058 - RNA, 1410 nt, Artificial Sequence; identical to SEQ ID NO: 77746
  derived and/or modified sequence opt1 from neuraminidase__InfluenzaA__ACT22013

SEQ ID NO: 78059 - RNA, 1410 nt, Artificial Sequence; identical to SEQ ID NO: 77746
  derived and/or modified sequence opt1 from neuraminidase__InfluenzaA__ACT22014

SEQ ID NO: 78060 - RNA, 1410 nt, Artificial Sequence; identical to SEQ ID NO: 77736
  derived and/or modified sequence opt1 from neuraminidase__InfluenzaA__ACT22015

SEQ ID NO: 78061 - RNA, 1410 nt, Artificial Sequence
  derived and/or modified sequence opt1 from neuraminidase__InfluenzaA__ACT22016
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78062 - RNA, 1410 nt, Artificial Sequence; identical to SEQ ID NO: 77746
  derived and/or modified sequence opt1 from neuraminidase__InfluenzaA__ACT22017

SEQ ID NO: 78063 - RNA, 1410 nt, Artificial Sequence; identical to SEQ ID NO: 77746
  derived and/or modified sequence opt1 from neuraminidase__InfluenzaA__ACT22018

SEQ ID NO: 78064 - RNA, 1410 nt, Artificial Sequence; identical to SEQ ID NO: 77736
  derived and/or modified sequence opt1 from neuraminidase__InfluenzaA__ACT22506

SEQ ID NO: 78065 - RNA, 1410 nt, Artificial Sequence; identical to SEQ ID NO: 77746
  derived and/or modified sequence opt1 from neuraminidase__InfluenzaA__ACT22511

SEQ ID NO: 78066 - RNA, 1410 nt, Artificial Sequence; identical to SEQ ID NO: 77746
  derived and/or modified sequence opt1 from neuraminidase__InfluenzaA__ACT33121

SEQ ID NO: 78067 - RNA, 1410 nt, Artificial Sequence; identical to SEQ ID NO: 77746
  derived and/or modified sequence opt1 from neuraminidase__InfluenzaA__ACT33124

SEQ ID NO: 78068 - RNA, 1410 nt, Artificial Sequence; identical to SEQ ID NO: 77746
  derived and/or modified sequence opt1 from neuraminidase__InfluenzaA__ACT33126

SEQ ID NO: 78069 - RNA, 1410 nt, Artificial Sequence; identical to SEQ ID NO: 77736
  derived and/or modified sequence opt1 from neuraminidase__InfluenzaA__ACT35526

SEQ ID NO: 78070 - RNA, 1410 nt, Artificial Sequence; identical to SEQ ID NO: 77746
  derived and/or modified sequence opt1 from neuraminidase__InfluenzaA__ACT36507

SEQ ID NO: 78071 - RNA, 1410 nt, Artificial Sequence; identical to SEQ ID NO: 77746
  derived and/or modified sequence opt1 from neuraminidase__InfluenzaA__ACT36672

SEQ ID NO: 78072 - RNA, 1410 nt, Artificial Sequence; identical to SEQ ID NO: 77746
  derived and/or modified sequence opt1 from neuraminidase__InfluenzaA__ACT36673

SEQ ID NO: 78073 - RNA, 1410 nt, Artificial Sequence; identical to SEQ ID NO: 77746
  derived and/or modified sequence opt1 from neuraminidase__InfluenzaA__ACT36674

SEQ ID NO: 78074 - RNA, 1410 nt, Artificial Sequence; identical to SEQ ID NO: 77746
  derived and/or modified sequence opt1 from neuraminidase__InfluenzaA__ACT36675

SEQ ID NO: 78075 - RNA, 1410 nt, Artificial Sequence; identical to SEQ ID NO: 77746
  derived and/or modified sequence opt1 from neuraminidase__InfluenzaA__ACT36677

SEQ ID NO: 78076 - RNA, 1410 nt, Artificial Sequence
  derived and/or modified sequence opt1 from neuraminidase__InfluenzaA__ACT36678
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcgccagagcgucguguccgugaagcuggccggcaacagcucccucugcccggucagcgggugggccaucuacuccaaggacaacagcgugcggaucggcuccaagggcgacguguucgucauccgcgagcccuucaucagcugcagcccccuggagugccggaccuucuuccugacccagggggcccuccugaacgacaagcacuccaacggcaccaucaaggaccgcucccccuaccggacgcugaugagcugcccgaucggggaggugcccucccccuacaacagccgcuucgagagcguggccugguccgcgagcgccugccacgacggcaucaacuggcucaccaucgggaucuccggccccgacaacggcgccgucgccgugcugaaguacaacgggaucaucaccgacaccaucaagagcuggcggaacaacauccugcgcacgcaggaguccgagugcgcgugcgugaacggcagcugcuucaccgucaugaccgacgggccguccaacggccaggccagcuacaagaucuuccggaucgagaagggcaagaucgugaaguccguggagaugaacgcccccaacuaccacuacgaggagugcagcugcuaccccgacuccagcgagaucacgugcgucugccgcgacaacuggcacggguccaaccggcccugggugagcuucaaccagaaccucgaguaccagaucggcuacaucugcuccgggaucuucggcgacaacccgcgccccaacgacaagaccgggagcugcggccccguguccagcaacggcgccaacggggucaagggcuucuccuucaaguacgggaacggcguguggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucguccagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 78077 - RNA, 1410 nt, Artificial Sequence; identical to SEQ ID NO: 77736
  derived and/or modified sequence opt1 from neuraminidase__InfluenzaA__ACT36679

SEQ ID NO: 78078 - RNA, 1410 nt, Artificial Sequence; identical to SEQ ID NO: 77746
  derived and/or modified sequence opt1 from neuraminidase__InfluenzaA__ACT36680

SEQ ID NO: 78079 - RNA, 1410 nt, Artificial Sequence; identical to SEQ ID NO: 77736
  derived and/or modified sequence opt1 from neuraminidase__InfluenzaA__ACT36682

SEQ ID NO: 78080 - RNA, 1410 nt, Artificial Sequence; identical to SEQ ID NO: 77736
  derived and/or modified sequence opt1 from neuraminidase__InfluenzaA__ACT36683

SEQ ID NO: 78081 - RNA, 1410 nt, Artificial Sequence; identical to SEQ ID NO: 77746
  derived and/or modified sequence opt1 from neuraminidase__InfluenzaA__ACT36684

SEQ ID NO: 78082 - RNA, 1410 nt, Artificial Sequence; identical to SEQ ID NO: 77736
  derived and/or modified sequence opt1 from neuraminidase__InfluenzaA__ACT36685

SEQ ID NO: 78083 - RNA, 1410 nt, Artificial Sequence; identical to SEQ ID NO: 77736
  derived and/or modified sequence opt1 from neuraminidase__InfluenzaA__ACT36686

SEQ ID NO: 78084 - RNA, 1410 nt, Artificial Sequence; identical to SEQ ID NO: 77736
  derived and/or modified sequence opt1 from neuraminidase__InfluenzaA__ACT36687

SEQ ID NO: 78085 - RNA, 1410 nt, Artificial Sequence
  derived and/or modified sequence opt1 from neuraminidase__InfluenzaA__ACT36688
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuacaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78086 - RNA, 1410 nt, Artificial Sequence; identical to SEQ ID NO: 77736
  derived and/or modified sequence opt1 from neuraminidase__InfluenzaA__ACT36689

SEQ ID NO: 78087 - RNA, 1410 nt, Artificial Sequence; identical to SEQ ID NO: 77776
  derived and/or modified sequence opt1 from neuraminidase__InfluenzaA__ACT36690

SEQ ID NO: 78088 - RNA, 1410 nt, Artificial Sequence; identical to SEQ ID NO: 77736
  derived and/or modified sequence opt1 from neuraminidase__InfluenzaA__ACT36691

SEQ ID NO: 78089 - RNA, 1410 nt, Artificial Sequence; identical to SEQ ID NO: 77776
  derived and/or modified sequence opt1 from neuraminidase__InfluenzaA__ACT36693

SEQ ID NO: 78090 - RNA, 1410 nt, Artificial Sequence; identical to SEQ ID NO: 77746
  derived and/or modified sequence opt1 from neuraminidase__InfluenzaA__ACT36694

SEQ ID NO: 78091 - RNA, 1410 nt, Artificial Sequence; identical to SEQ ID NO: 77746
  derived and/or modified sequence opt1 from neuraminidase__InfluenzaA__ACT36695

SEQ ID NO: 78092 - RNA, 1410 nt, Artificial Sequence; identical to SEQ ID NO: 77746
  derived and/or modified sequence opt1 from neuraminidase__InfluenzaA__ACT52684

SEQ ID NO: 78093 - RNA, 1410 nt, Artificial Sequence; identical to SEQ ID NO: 77736
  derived and/or modified sequence opt1 from neuraminidase__InfluenzaA__ACT54608

SEQ ID NO: 78094 - RNA, 1410 nt, Artificial Sequence
  derived and/or modified sequence opt1 from neuraminidase__InfluenzaA__ACT66157
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagauccuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78095 - RNA, 1410 nt, Artificial Sequence; identical to SEQ ID NO: 77746
  derived and/or modified sequence opt1 from neuraminidase__InfluenzaA__ACT67117

SEQ ID NO: 78096 - RNA, 1410 nt, Artificial Sequence; identical to SEQ ID NO: 77736
  derived and/or modified sequence opt1 from neuraminidase__InfluenzaA__ACT67121

SEQ ID NO: 78097 - RNA, 1410 nt, Artificial Sequence; identical to SEQ ID NO: 77746
  derived and/or modified sequence opt1 from neuraminidase__InfluenzaA__ACT67240

SEQ ID NO: 78098 - RNA, 1410 nt, Artificial Sequence; identical to SEQ ID NO: 77746
  derived and/or modified sequence opt1 from neuraminidase__InfluenzaA__ACT67241

SEQ ID NO: 78099 - RNA, 1410 nt, Artificial Sequence; identical to SEQ ID NO: 77746
  derived and/or modified sequence opt1 from neuraminidase__InfluenzaA__ACT67243

SEQ ID NO: 78100 - RNA, 1410 nt, Artificial Sequence
  derived and/or modified sequence opt1 from neuraminidase__InfluenzaA__ACT67256
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78101 - RNA, 1410 nt, Artificial Sequence
  derived and/or modified sequence opt1 from neuraminidase__InfluenzaA__ACT68161
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaaggccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 78102 - RNA, 1410 nt, Artificial Sequence; identical to SEQ ID NO: 77736
  derived and/or modified sequence opt1 from neuraminidase__InfluenzaA__ACT68162

SEQ ID NO: 78103 - RNA, 1410 nt, Artificial Sequence; identical to SEQ ID NO: 77736
  derived and/or modified sequence opt1 from neuraminidase__InfluenzaA__ACT68163

SEQ ID NO: 78104 - RNA, 1410 nt, Artificial Sequence; identical to SEQ ID NO: 77736
  derived and/or modified sequence opt1 from neuraminidase__InfluenzaA__ACT68164

SEQ ID NO: 78105 - RNA, 1410 nt, Artificial Sequence; identical to SEQ ID NO: 77746
  derived and/or modified sequence opt1 from neuraminidase__InfluenzaA__ACT68166

SEQ ID NO: 78106 - RNA, 1410 nt, Artificial Sequence; identical to SEQ ID NO: 77746
  derived and/or modified sequence opt1 from neuraminidase__InfluenzaA__ACT68167

SEQ ID NO: 78107 - RNA, 1410 nt, Artificial Sequence; identical to SEQ ID NO: 77776
  derived and/or modified sequence opt1 from neuraminidase__InfluenzaA__ACT68168

SEQ ID NO: 78108 - RNA, 1410 nt, Artificial Sequence
  derived and/or modified sequence opt1 from neuraminidase__InfluenzaA__ACT68169
augaaccccaaccagaagaucaucaccaucggcagcgugugcaugaccaucgggauggccaaccugauccuccagaucggcaacaucaucuccaucuggaucagccacuccauccagcugggggaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgagaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucuccgaguggagcggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggccgagcugccguucacgaucgacaaguga

SEQ ID NO: 78109 - RNA, 1410 nt, Artificial Sequence; identical to SEQ ID NO: 77736
  derived and/or modified sequence opt1 from neuraminidase__InfluenzaA__ACT68171

SEQ ID NO: 78110 - RNA, 1410 nt, Artificial Sequence; identical to SEQ ID NO: 77736
  derived and/or modified sequence opt1 from neuraminidase__InfluenzaA__ACT68172

SEQ ID NO: 78111 - RNA, 1410 nt, Artificial Sequence; identical to SEQ ID NO: 77746
  derived and/or modified sequence opt1 from neuraminidase__InfluenzaA__ACT68173

SEQ ID NO: 78112 - RNA, 1410 nt, Artificial Sequence; identical to SEQ ID NO: 77746
  derived and/or modified sequence opt1 from neuraminidase__InfluenzaA__ACT68174

SEQ ID NO: 78113 - RNA, 1410 nt, Artificial Sequence
  derived and/or modified sequence opt1 from neuraminidase__InfluenzaA__ACT68175
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccggcgagaucacgugcgucugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 78114 - RNA, 1410 nt, Artificial Sequence; identical to SEQ ID NO: 77746
  derived and/or modified sequence opt1 from neuraminidase__InfluenzaA__ACT68176

SEQ ID NO: 78115 - RNA, 1410 nt, Artificial Sequence; identical to SEQ ID NO: 77746
  derived and/or modified sequence opt1 from neuraminidase__InfluenzaA__ACT68177

SEQ ID NO: 78116 - RNA, 1410 nt, Artificial Sequence; identical to SEQ ID NO: 77746
  derived and/or modified sequence opt1 from neuraminidase__InfluenzaA__ACT68178

SEQ ID NO: 78117 - RNA, 1410 nt, Artificial Sequence; identical to SEQ ID NO: 78113
  derived and/or modified sequence opt1 from neuraminidase__InfluenzaA__ACT68179

SEQ ID NO: 78118 - RNA, 1410 nt, Artificial Sequence; identical to SEQ ID NO: 77746
  derived and/or modified sequence opt1 from neuraminidase__InfluenzaA__ACT68180

SEQ ID NO: 78119 - RNA, 1410 nt, Artificial Sequence; identical to SEQ ID NO: 77776
  derived and/or modified sequence opt1 from neuraminidase__InfluenzaA__ACT79145

SEQ ID NO: 78120 - RNA, 1410 nt, Artificial Sequence
  derived and/or modified sequence opt1 from neuraminidase__InfluenzaA__ACT79155
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucggcggcugggccaucuacagcaaggacaacuccgugcgcaucgggagcaagggcgacguguucgucauccgggagcccuucaucuccugcagccugcuggagugccgcaccuucuuccucacccagggggcccugcugaacgacaagcacuccaacggcaccaucaaggaccggagccccuaccgcacgcucauguccugccccaucggggaggugccgagccccuacaacucccgguucgagagcguggccuggagcgcguccgccugccacgacggcaucaacuggcugaccaucggcaucagcgggcccgacaacggcgccgucgccgugcugaaguacaacgggaucaucaccgacaccaucaaguccuggcgcaacaacauccuccggacgcaggagagcgagugcgcgugcgugaacggcuccugcuucaccgucaugaccgacggccccagcaacgggcaggccuccuacaagaucuuccgcaucgagaagggcaagaucgucaagagcguggagaugaacgccccgaacuaccacuacgaggagugcuccugcuaccccgacagcuccgagaucacgugcgugugccgggacaacuggcacgggagcaaccgccccuggguguccuucaaccagaaccuggaguaccagaucggcuacaucugcagcgggaucuucggcgacaacccccggccgaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcaccccgagcugacgggccucgacugcauccgcccgugcuucuggguggagcugauccgggggcgccccaaggagaacaccaucuggaccuccggcagcuccaucagcuucugcggggucaacuccgacaccgugggcuggagcuggcccgacggcgccgagcugcccuucacgaucgacaaguga

SEQ ID NO: 78121 - RNA, 1410 nt, Artificial Sequence; identical to SEQ ID NO: 77736
  derived and/or modified sequence opt1 from neuraminidase__InfluenzaA__ACT79165

SEQ ID NO: 78122 - RNA, 1410 nt, Artificial Sequence; identical to SEQ ID NO: 77736
  derived and/or modified sequence opt1 from neuraminidase__InfluenzaA__ACT79175

SEQ ID NO: 78123 - RNA, 1410 nt, Artificial Sequence; identical to SEQ ID NO: 77746
  derived and/or modified sequence opt1 from neuraminidase__InfluenzaA__ACT79185

SEQ ID NO: 78124 - RNA, 1410 nt, Artificial Sequence; identical to SEQ ID NO: 77746
  derived and/or modified sequence opt1 from neuraminidase__InfluenzaA__ACT79622

SEQ ID NO: 78125 - RNA, 1410 nt, Artificial Sequence; identical to SEQ ID NO: 78113
  derived and/or modified sequence opt1 from neuraminidase__InfluenzaA__ACT79630

SEQ ID NO: 78126 - RNA, 1410 nt, Artificial Sequence; identical to SEQ ID NO: 77746
  derived and/or modified sequence opt1 from neuraminidase__InfluenzaA__ACT83798

SEQ ID NO: 78127 - RNA, 1410 nt, Artificial Sequence; identical to SEQ ID NO: 77746
  derived and/or modified sequence opt1 from neuraminidase__InfluenzaA__ACT83808

SEQ ID NO: 78128 - RNA, 1410 nt, Artificial Sequence; identical to SEQ ID NO: 77746
  derived and/or modified sequence opt1 from neuraminidase__InfluenzaA__ACT83818

SEQ ID NO: 78129 - RNA, 1410 nt, Artificial Sequence; identical to SEQ ID NO: 77746
  derived and/or modified sequence opt1 from neuraminidase__InfluenzaA__ACT83828

SEQ ID NO: 78130 - RNA, 1410 nt, Artificial Sequence; identical to SEQ ID NO: 77746
  derived and/or modified sequence opt1 from neuraminidase__InfluenzaA__ACT83838

SEQ ID NO: 78131 - RNA, 1410 nt, Artificial Sequence; identical to SEQ ID NO: 77736
  derived and/or modified sequence opt1 from neuraminidase__InfluenzaA__ACT83848

SEQ ID NO: 78132 - RNA, 1410 nt, Artificial Sequence; identical to SEQ ID NO: 77736
  derived and/or modified sequence opt1 from neuraminidase__InfluenzaA__ACT83858

SEQ ID NO: 78133 - RNA, 1410 nt, Artificial Sequence; identical to SEQ ID NO: 77746
  derived and/or modified sequence opt1 from neuraminidase__InfluenzaA__ACT83868

SEQ ID NO: 78134 - RNA, 1410 nt, Artificial Sequence; identical to SEQ ID NO: 77746
  derived and/or modified sequence opt1 from neuraminidase__InfluenzaA__ACT83878

SEQ ID NO: 78135 - RNA, 1410 nt, Artificial Sequence; identical to SEQ ID NO: 77746
  derived and/or modified sequence opt1 from neuraminidase__InfluenzaA__ACT86002

SEQ ID NO: 78136 - RNA, 1410 nt, Artificial Sequence; identical to SEQ ID NO: 77746
  derived and/or modified sequence opt1 from neuraminidase__InfluenzaA__ACT86012

SEQ ID NO: 78137 - RNA, 1410 nt, Artificial Sequence; identical to SEQ ID NO: 77746
  derived and/or modified sequence opt1 from neuraminidase__InfluenzaA__ACT86022

SEQ ID NO: 78138 - RNA, 1410 nt, Artificial Sequence; identical to SEQ ID NO: 77736
  derived and/or modified sequence opt1 from neuraminidase__InfluenzaA__ACT86032

SEQ ID NO: 78139 - RNA, 1410 nt, Artificial Sequence; identical to SEQ ID NO: 77746
  derived and/or modified sequence opt1 from neuraminidase__InfluenzaA__ACT86042

SEQ ID NO: 78140 - RNA, 1410 nt, Artificial Sequence; identical to SEQ ID NO: 77746
  derived and/or modified sequence opt1 from neuraminidase__InfluenzaA__ACT86052

SEQ ID NO: 78141 - RNA, 1410 nt, Artificial Sequence; identical to SEQ ID NO: 77746
  derived and/or modified sequence opt1 from neuraminidase__InfluenzaA__ACT86062

SEQ ID NO: 78142 - RNA, 1410 nt, Artificial Sequence; identical to SEQ ID NO: 77746
  derived and/or modified sequence opt1 from neuraminidase__InfluenzaA__ACT86072

SEQ ID NO: 78143 - RNA, 1410 nt, Artificial Sequence; identical to SEQ ID NO: 77746
  derived and/or modified sequence opt1 from neuraminidase__InfluenzaA__ACT86082

SEQ ID NO: 78144 - RNA, 1410 nt, Artificial Sequence; identical to SEQ ID NO: 77746
  derived and/or modified sequence opt1 from neuraminidase__InfluenzaA__ACT86092

SEQ ID NO: 78145 - RNA, 1410 nt, Artificial Sequence; identical to SEQ ID NO: 77746
  derived and/or modified sequence opt1 from neuraminidase__InfluenzaA__ACT86102

SEQ ID NO: 78146 - RNA, 1410 nt, Artificial Sequence; identical to SEQ ID NO: 77746
  derived and/or modified sequence opt1 from neuraminidase__InfluenzaA__ACT86112

SEQ ID NO: 78147 - RNA, 1410 nt, Artificial Sequence; identical to SEQ ID NO: 77746
  derived and/or modified sequence opt1 from neuraminidase__InfluenzaA__ACT86122

SEQ ID NO: 78148 - RNA, 1410 nt, Artificial Sequence; identical to SEQ ID NO: 77746
  derived and/or modified sequence opt1 from neuraminidase__InfluenzaA__ACT86132

SEQ ID NO: 78149 - RNA, 1410 nt, Artificial Sequence; identical to SEQ ID NO: 77746
  derived and/or modified sequence opt1 from neuraminidase__InfluenzaA__ACT86142

SEQ ID NO: 78150 - RNA, 1410 nt, Artificial Sequence; identical to SEQ ID NO: 77736
  derived and/or modified sequence opt1 from neuraminidase__InfluenzaA__ACT97323

SEQ ID NO: 78151 - RNA, 1410 nt, Artificial Sequence; identical to SEQ ID NO: 77746
  derived and/or modified sequence opt1 from neuraminidase__InfluenzaA__ACU00934

SEQ ID NO: 78152 - RNA, 1410 nt, Artificial Sequence; identical to SEQ ID NO: 77746
  derived and/or modified sequence opt1 from neuraminidase__InfluenzaA__ACU00944

SEQ ID NO: 78153 - RNA, 1410 nt, Artificial Sequence; identical to SEQ ID NO: 78100
  derived and/or modified sequence opt1 from neuraminidase__InfluenzaA__ACU00954

SEQ ID NO: 78154 - RNA, 1410 nt, Artificial Sequence
  derived and/or modified sequence opt1 from neuraminidase__InfluenzaA__ACU12497
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaucaccgagaucgucuaccucaccaacaccacgaucgagcgggagaucugcccgaagcugguggaguaccgcaacugguccaagccccagugccgggugaccggguucgcgcccuucagcaaggacaacuccauccgccugagcgccggcggggacaucugggucacccgggagcccuacguguccugcgacccgggcaagugcuaccaguucgcccucgggcagggcaccacgcugaacaaccgccacagcaacgacaccgugcacgaccggacccccuaccgcacccugcucaugaacgagcugggcguccccuuccaccuggggacgaagcaggucugcaucgccugguccagcuccagcugccacgacggcaaggccuggcuccacgugugcgugaccgggcacgacgagaacgcgaccgccuccuucaucuacgacggccggcugguggacagcaucguguccuggagcaagaacauccugcgcacccaggaguccgagugcgucugcaucaacgggacgugcaccguggugaugaccgacggcagcgccuccgagcgggccgacaccaagauccucuucaucgaggagggcaagaucguccacaucagcccccugagcggguccgcgcagcacguggaggagugcagcugcuacccgcgcuaccccggcgugcggugcgucugccgcgacaacuggaagggguccaaccggcccaucguggacaucaacgugaaggacuacagcaucgucuccagcuacgugugcuccggccuggucggcgacacgccccgcaagaacgacagcuccagcuccagcuacugccggaacccgaacaacgagaaggggucccacggcgugaaggggugggccuucgacgacggcaacgacguguggauggggcgcaccaucggcgaggagcuccggagcggcuacgagaccuucaaggucaucgggggcugguccacccccaacagcaagcugcagacgaaccgccaggugaucguggaccgggggaaccgcuccggcuacagcgggaucuucuccgucgagggcaagagcugcaucaaccgcugcuucuacguggagcugauccggggccgcaagcaggagaccaaggugugguggaccagcaacuccaucgucguguucugcgggaccagcggcacguacgggaccggcuccuggcccgacggggccgacaucaaccucaugcccaucuga

SEQ ID NO: 78155 - RNA, 1413 nt, Artificial Sequence; identical to SEQ ID NO: 77640
  derived and/or modified sequence opt1 from neuraminidase__InfluenzaA__ACU12508

SEQ ID NO: 78156 - RNA, 1410 nt, Artificial Sequence
  derived and/or modified sequence opt1 from neuraminidase__InfluenzaA__ACU12519
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacgagaacgcgaccgccagcuucaucuacaacgggcgccugguggacuccguggucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaccaggagaccgaggugcuguggaccagcaacuccaucgucguguucugcgggaccagcggcacguacgggaccggcuccuggccggacggggccgacaucaaccugaugcccaucuga

SEQ ID NO: 78157 - RNA, 1410 nt, Artificial Sequence
  derived and/or modified sequence opt1 from neuraminidase__InfluenzaA__ACU12530
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcaacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 78158 - RNA, 1410 nt, Artificial Sequence
  derived and/or modified sequence opt1 from neuraminidase__InfluenzaA__ACU12541
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaaguggcagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 78159 - RNA, 1410 nt, Artificial Sequence
  derived and/or modified sequence opt1 from neuraminidase__InfluenzaA__ACU12552
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcggcuacgugugcuccggccuggugggggacacgccccgcaagaacgacagcuccagcuccagccacugcuccgaccccaacaacgaggagggcgggcacggcgucaaggggugggccuucgacgacggcaacgacguguggaugggccggaccaucagcgagaagcuccgcuccggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 78160 - RNA, 1413 nt, Artificial Sequence
  derived and/or modified sequence opt1 from neuraminidase__InfluenzaA__ACU12574
augaaccccaaccagaagaucaucaccaucggcagcaucuccaucgccaucgggaucaucaaccugaugcuccagaucggcaacaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggagcuccaucagcuucugcggcgucaacuccgacacggccaacuggagcuggcccgacggggccgagcugcccuucaccaucgacaaguga

SEQ ID NO: 78161 - RNA, 1413 nt, Artificial Sequence; identical to SEQ ID NO: 77640
  derived and/or modified sequence opt1 from neuraminidase__InfluenzaA__ACU12585

SEQ ID NO: 78162 - RNA, 1413 nt, Artificial Sequence
  derived and/or modified sequence opt1 from neuraminidase__InfluenzaA__ACU12596
augaaccccaaccagaagaucaucaccaucggcagcaucuccaucgccaucgggaucaucagccugaugcuccagaucggcuccaucaucagcaucugggccucccacagcauccgcaccgggucccagaacaacacgggcaucugcaaccagcggaucaucaccuacgagaacagcaccugggugaaccacaccuacgucaacaucaacaacacgaacgugguggcgggggaggacaagaaguccgucacccuggccggcaacagcucccugugcagcaucuccggcugggccaucuacaccaaggacaacagcauccgcaucggguccaagggcgacguguucgugauccgggagccguucaucagcugcucccaccucgagugccgcaccuucuuccugacgcagggggcccugcucaacgacaagcacagcaacggcaccgucaaggaccggucccccuaccgcgcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucaccggcacgaucaagagcuggaagaagcagauccugcggacccaggaguccgagugcgugugcaugaacgggagcugcuucaccaucaugaccgacggccccuccaacaaggccgccagcuacaagaucuucaagaucgagaaggggaaggugacgaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucagcgugaagcaggacgucguggccaucaccgacuggagcggguacuccggcagcuucgugcagcaccccgagcucaccggccuggacugcauccgccccugcuucugggucgagcuggugcgggggcucccgcgcgagaacacgaccaucuggaccuccggcagcuccaucagcuucugcggggucaacuccgacaccgccaacuggagcuggcccgacggcgccgagcugcccuucacgaucgacaaguga

SEQ ID NO: 78163 - RNA, 1410 nt, Artificial Sequence; identical to SEQ ID NO: 77746
  derived and/or modified sequence opt1 from neuraminidase__InfluenzaA__ACU13077

SEQ ID NO: 78164 - RNA, 1410 nt, Artificial Sequence; identical to SEQ ID NO: 77746
  derived and/or modified sequence opt1 from neuraminidase__InfluenzaA__ACU13078

SEQ ID NO: 78165 - RNA, 1410 nt, Artificial Sequence; identical to SEQ ID NO: 77746
  derived and/or modified sequence opt1 from neuraminidase__InfluenzaA__ACU13079

SEQ ID NO: 78166 - RNA, 1410 nt, Artificial Sequence; identical to SEQ ID NO: 77746
  derived and/or modified sequence opt1 from neuraminidase__InfluenzaA__ACU13080

SEQ ID NO: 78167 - RNA, 1410 nt, Artificial Sequence; identical to SEQ ID NO: 77736
  derived and/or modified sequence opt1 from neuraminidase__InfluenzaA__ACU13081

SEQ ID NO: 78168 - RNA, 1410 nt, Artificial Sequence; identical to SEQ ID NO: 77746
  derived and/or modified sequence opt1 from neuraminidase__InfluenzaA__ACU13082

SEQ ID NO: 78169 - RNA, 1410 nt, Artificial Sequence; identical to SEQ ID NO: 77746
  derived and/or modified sequence opt1 from neuraminidase__InfluenzaA__ACU13083

SEQ ID NO: 78170 - RNA, 1410 nt, Artificial Sequence
  derived and/or modified sequence opt1 from neuraminidase__InfluenzaA__ACU13084
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacagcucccucugcccggugggcggcugggccaucuacagcaaggacaacuccguccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacucccgguucgagagcguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 78171 - RNA, 1410 nt, Artificial Sequence; identical to SEQ ID NO: 77746
  derived and/or modified sequence opt1 from neuraminidase__InfluenzaA__ACU16799

SEQ ID NO: 78172 - RNA, 1410 nt, Artificial Sequence; identical to SEQ ID NO: 77746
  derived and/or modified sequence opt1 from neuraminidase__InfluenzaA__ACU16861

SEQ ID NO: 78173 - RNA, 1410 nt, Artificial Sequence; identical to SEQ ID NO: 77746
  derived and/or modified sequence opt1 from neuraminidase__InfluenzaA__ACU16934

SEQ ID NO: 78174 - RNA, 1410 nt, Artificial Sequence; identical to SEQ ID NO: 77746
  derived and/or modified sequence opt1 from neuraminidase__InfluenzaA__ACU16997

SEQ ID NO: 78175 - RNA, 1410 nt, Artificial Sequence; identical to SEQ ID NO: 77746
  derived and/or modified sequence opt1 from neuraminidase__InfluenzaA__ACU17130

SEQ ID NO: 78176 - RNA, 1410 nt, Artificial Sequence; identical to SEQ ID NO: 77746
  derived and/or modified sequence opt1 from neuraminidase__InfluenzaA__ACU17191

SEQ ID NO: 78177 - RNA, 1410 nt, Artificial Sequence
  derived and/or modified sequence opt1 from neuraminidase__InfluenzaA__ACU17262
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78178 - RNA, 1410 nt, Artificial Sequence; identical to SEQ ID NO: 77746
  derived and/or modified sequence opt1 from neuraminidase__InfluenzaA__ACU17325

SEQ ID NO: 78179 - RNA, 1410 nt, Artificial Sequence; identical to SEQ ID NO: 77746
  derived and/or modified sequence opt1 from neuraminidase__InfluenzaA__ACU17393

SEQ ID NO: 78180 - RNA, 1410 nt, Artificial Sequence; identical to SEQ ID NO: 77746
  derived and/or modified sequence opt1 from neuraminidase__InfluenzaA__ACU17454

SEQ ID NO: 78181 - RNA, 1410 nt, Artificial Sequence; identical to SEQ ID NO: 77746
  derived and/or modified sequence opt1 from neuraminidase__InfluenzaA__ACU17524

SEQ ID NO: 78182 - RNA, 1410 nt, Artificial Sequence; identical to SEQ ID NO: 78100
  derived and/or modified sequence opt1 from neuraminidase__InfluenzaA__ACU27043

SEQ ID NO: 78183 - RNA, 1413 nt, Artificial Sequence
  derived and/or modified sequence opt1 from neuraminidase__InfluenzaA__ACU27415
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucaccuucgccggcaacuccagccugugcuccaucagcggcugggccaucuacaccaaggacaacuccauccggaucgggagcaagggcgacguguucgugauccgcgagccguucaucuccugcagccaccuggagugccggacguucuuccucacccagggggcccugcugaacgacaagcacuccaacggcaccgucaaggaccgcagccccuaccgggcccucauguccugcccccugggggaggcgcccagcccguacaacagcaaguucgaguccguggccuggagcgccuccgccugccacgacggcaugggcuggcugaccaucgggaucagcggccccgacaacggggcgguggccguccucaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcugaacgcccccaacuucuacuacgaggagugcuccugcuacccggacaccggcaucgucaugugcgugugccgggacaacuggcacgggagcaaccgccccuggguguccuucaaccagaaccucgacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcugacgggccucgacugcauccggcccugcuucugggucgagcuggugcgcgggcugccgcgggagaacaccaccaucuggaccagcggcuccagcaucuccuucugcggggucaacagcgacacggccaacugguccuggcccgacggcgccgagcuccccuucaccaucgacaaguga

SEQ ID NO: 78184 - RNA, 1413 nt, Artificial Sequence; identical to SEQ ID NO: 78183
  derived and/or modified sequence opt1 from neuraminidase__InfluenzaA__ACU27416

SEQ ID NO: 78185 - RNA, 1410 nt, Artificial Sequence; identical to SEQ ID NO: 77736
  derived and/or modified sequence opt1 from neuraminidase__InfluenzaA__ACU29961

SEQ ID NO: 78186 - RNA, 1410 nt, Artificial Sequence
  derived and/or modified sequence opt1 from neuraminidase__InfluenzaA__ACU29971
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggagcgacggcgccgagcugcccuucacgaucgacaaguga

SEQ ID NO: 78187 - RNA, 1410 nt, Artificial Sequence; identical to SEQ ID NO: 77746
  derived and/or modified sequence opt1 from neuraminidase__InfluenzaA__ACU29981

SEQ ID NO: 78188 - RNA, 1410 nt, Artificial Sequence; identical to SEQ ID NO: 77746
  derived and/or modified sequence opt1 from neuraminidase__InfluenzaA__ACU29991

SEQ ID NO: 78189 - RNA, 1410 nt, Artificial Sequence; identical to SEQ ID NO: 77746
  derived and/or modified sequence opt1 from neuraminidase__InfluenzaA__ACU30001

SEQ ID NO: 78190 - RNA, 1410 nt, Artificial Sequence; identical to SEQ ID NO: 77746
  derived and/or modified sequence opt1 from neuraminidase__InfluenzaA__ACU30021

SEQ ID NO: 78191 - RNA, 1410 nt, Artificial Sequence
  derived and/or modified sequence opt1 from neuraminidase__InfluenzaA__ACU30085
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugauggggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccaacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78192 - RNA, 1410 nt, Artificial Sequence; identical to SEQ ID NO: 78170
  derived and/or modified sequence opt1 from neuraminidase__InfluenzaA__ACU30095

SEQ ID NO: 78193 - RNA, 1410 nt, Artificial Sequence; identical to SEQ ID NO: 77746
  derived and/or modified sequence opt1 from neuraminidase__InfluenzaA__ACU30105

SEQ ID NO: 78194 - RNA, 1410 nt, Artificial Sequence; identical to SEQ ID NO: 77746
  derived and/or modified sequence opt1 from neuraminidase__InfluenzaA__ACU30114

SEQ ID NO: 78195 - RNA, 1410 nt, Artificial Sequence; identical to SEQ ID NO: 77746
  derived and/or modified sequence opt1 from neuraminidase__InfluenzaA__ACU30123

SEQ ID NO: 78196 - RNA, 1410 nt, Artificial Sequence
  derived and/or modified sequence opt1 from neuraminidase__InfluenzaA__ACU31177
augaaccccaaccagaagaucaucaccaucggcagcgugugcaugaccaucgggauggccaaccugauccuccagaucggcaacaucaucuccaucuggaucagccaccugauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggagcgcguccgccugccacgacgggaucagcuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78197 - RNA, 1410 nt, Artificial Sequence; identical to SEQ ID NO: 77746
  derived and/or modified sequence opt1 from neuraminidase__InfluenzaA__ACU31178

SEQ ID NO: 78198 - RNA, 1410 nt, Artificial Sequence; identical to SEQ ID NO: 77736
  derived and/or modified sequence opt1 from neuraminidase__InfluenzaA__ACU31179

SEQ ID NO: 78199 - RNA, 1410 nt, Artificial Sequence; identical to SEQ ID NO: 77736
  derived and/or modified sequence opt1 from neuraminidase__InfluenzaA__ACU31180

SEQ ID NO: 78200 - RNA, 1410 nt, Artificial Sequence; identical to SEQ ID NO: 77736
  derived and/or modified sequence opt1 from neuraminidase__InfluenzaA__ACU31181

SEQ ID NO: 78201 - RNA, 1410 nt, Artificial Sequence; identical to SEQ ID NO: 77746
  derived and/or modified sequence opt1 from neuraminidase__InfluenzaA__ACU31182

SEQ ID NO: 78202 - RNA, 1410 nt, Artificial Sequence; identical to SEQ ID NO: 77776
  derived and/or modified sequence opt1 from neuraminidase__InfluenzaA__ACU31183

SEQ ID NO: 78203 - RNA, 1410 nt, Artificial Sequence; identical to SEQ ID NO: 77746
  derived and/or modified sequence opt1 from neuraminidase__InfluenzaA__ACU31184

SEQ ID NO: 78204 - RNA, 1410 nt, Artificial Sequence; identical to SEQ ID NO: 77736
  derived and/or modified sequence opt1 from neuraminidase__InfluenzaA__ACU31185

SEQ ID NO: 78205 - RNA, 1410 nt, Artificial Sequence; identical to SEQ ID NO: 77736
  derived and/or modified sequence opt1 from neuraminidase__InfluenzaA__ACU31186

SEQ ID NO: 78206 - RNA, 1410 nt, Artificial Sequence; identical to SEQ ID NO: 77736
  derived and/or modified sequence opt1 from neuraminidase__InfluenzaA__ACU31187

SEQ ID NO: 78207 - RNA, 1410 nt, Artificial Sequence; identical to SEQ ID NO: 77736
  derived and/or modified sequence opt1 from neuraminidase__InfluenzaA__ACU31188

SEQ ID NO: 78208 - RNA, 1350 nt, Artificial Sequence
  derived and/or modified sequence opt1 from neuraminidase__InfluenzaA__ACU46645
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaaccugcucaccgagaagaccguggccagcgucaagcuggcgggcaacuccagccugugccccaucaacgggugggccguguacuccaaggacaacagcauccgcaucggcuccaagggcgacguguucgucauccgggagcccuucaucagcugcucccaccucgagugccgcacguucuuccugacccagggggcccugcucaacgacaagcacagcaacggcaccgugaaggaccggagcccccaccgcacccugauguccgggccggugggcgaggcccccucccccuacaacagccgguucgaguacgucgccugguccgcgagcgccugccacgaccgcacgagccggcugaccaucgggaucuccggccccgacaacggcgccguggccgugcucaaguacaacgggaucaucaccgacaccaucaagagcuggcgcaacaacauccugcggacgcaggaguccgagugcgcgugcgucaacggcagcugcuucaccgugaugaccgacgggccguccaacggccaggccagccacaagaucuucaagauggagaagggcaagguggucaaguccguggagcuggacgcccccaacuaccacuacgaggagugcagcugcuaccccgacgccggggagaucacgugcgugugccgcgacaacuggcacggcuccaaccggcccugggucagcuucaaccagaaccucgaguaccagaucggguacaucugcuccggcguguucggggacaacccgcgccccaacgacggcgccggcagcugcgggcccguguccagcaacggcgcguacggggucaagggcuucuccuucaaguacgggaacggcguguggaucggccggaccaagagcaccaacucccgcagcggguucgagaugaucugggaccccaacggcuggaccgagaccgacuccagcuucagcgugaagcaggacaucgucgccaucacggacugguccggguacagcggcuccuucgugcagcacccggagcugaccgggcuggacugcauccggcccugcuucugggucgagcucauccgcggccggcccaaggagagcaccaucuggaccuccggcagcuccaucagcuucugcggggugaacuccgacacggugggcuggagcuggcccgacggggccgagcugccguucaccaucgacaaguga

SEQ ID NO: 78209 - RNA, 1410 nt, Artificial Sequence
  derived and/or modified sequence opt1 from neuraminidase__InfluenzaA__ACU56927
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgacaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78210 - RNA, 1410 nt, Artificial Sequence; identical to SEQ ID NO: 77901
  derived and/or modified sequence opt1 from neuraminidase__InfluenzaA__ACU56934

SEQ ID NO: 78211 - RNA, 1410 nt, Artificial Sequence; identical to SEQ ID NO: 77746
  derived and/or modified sequence opt1 from neuraminidase__InfluenzaA__ACU64791

SEQ ID NO: 78212 - RNA, 1410 nt, Artificial Sequence
  derived and/or modified sequence opt1 from neuraminidase__InfluenzaA__ACU64811
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacagcucccucugcccggugagcggcugggccaucuacuccaaggacaacagcguccgcaucggcuccaagggggacguguucaucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78213 - RNA, 1410 nt, Artificial Sequence; identical to SEQ ID NO: 77511
  derived and/or modified sequence opt1 from neuraminidase__InfluenzaA__ACU79885

SEQ ID NO: 78214 - RNA, 1410 nt, Artificial Sequence; identical to SEQ ID NO: 75103
  derived and/or modified sequence opt1 from neuraminidase__InfluenzaA__ACU79896

SEQ ID NO: 78215 - RNA, 1410 nt, Artificial Sequence; identical to SEQ ID NO: 75103
  derived and/or modified sequence opt1 from neuraminidase__InfluenzaA__ACU79918

SEQ ID NO: 78216 - RNA, 1410 nt, Artificial Sequence; identical to SEQ ID NO: 75103
  derived and/or modified sequence opt1 from neuraminidase__InfluenzaA__ACU79929

SEQ ID NO: 78217 - RNA, 1413 nt, Artificial Sequence
  derived and/or modified sequence opt1 from neuraminidase__InfluenzaA__ACU79940
augaaccccaaccagaagaucaucaccaucggcagcaucuccaucgugaucgggaucaucagccugaugcuccagaucggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgccgggaaggacaagaccagcgugacccuggcgggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcccccagcccguacaacagcaaguucgaguccguggcguggagcgccuccgccugccacgacggcaugggcuggcucaccaucgggaucagcggccccgacaacggggccgucgcggugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacucccacuacgaggagugcagcugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcgaggggagcugcaacccggucacgguggacggcgccgacggggugaagggcuucuccuaccgguacggcaacggggucuggaucggccgcaccaagagcaaccggcugcgcaagggguucgagaugaucugggaccccaacggcuggaccgacaccgacuccgacuucagcgugaagcaggacguggucgcgaugacggacuggagcggguacuccggcagcuucgugcagcaccccgagcucaccggccuggacugcauccggcccugcuucugggucgagcuggugcgcgggcggccgcgcgagaacaccaccaucuggacguccggcagcuccaucagcuucugcggggugaacuccgacaccgccaacuggagcuggcccgacggcgccgagcuccccuucaccaucgacaaguga

SEQ ID NO: 78218 - RNA, 1410 nt, Artificial Sequence
  derived and/or modified sequence opt1 from neuraminidase__InfluenzaA__ACU79951
augaaccccaaccagaagaucaucaccaucggcagcgugucccugaccaucgagacggucugcuuccucaugcagaucgccauccuggccaccaccgugacccugcacuucaagcagcacgagugcgacagcccggcguccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccagcuccugccacgacgggaaggcguggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgccagcggccgggcggacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggacagccgguccggguacgagaccuucaaggucaucggcggguggagcacccccaacuccaagagccaggugaaccgccaggucaucgugggcaacaacaacugguccggguacagcggcaucuucagcguggagggcaaguccugcaucaaccggugcuucuacgucgagcugauccgcgggcgcccccaggagacccgggugugguggaccagcaacuccaucguggucuucugcggcaccagcgggacguacggcaccggguccuggcccgacggcgccaacaucaacuucaugccgaucuga

SEQ ID NO: 78219 - RNA, 1410 nt, Artificial Sequence; identical to SEQ ID NO: 77611
  derived and/or modified sequence opt1 from neuraminidase__InfluenzaA__ACU79973

SEQ ID NO: 78220 - RNA, 1413 nt, Artificial Sequence; identical to SEQ ID NO: 77640
  derived and/or modified sequence opt1 from neuraminidase__InfluenzaA__ACU79984

SEQ ID NO: 78221 - RNA, 1410 nt, Artificial Sequence; identical to SEQ ID NO: 77607
  derived and/or modified sequence opt1 from neuraminidase__InfluenzaA__ACU80006

SEQ ID NO: 78222 - RNA, 1410 nt, Artificial Sequence
  derived and/or modified sequence opt1 from neuraminidase__InfluenzaA__ACU80017
augaacaccaaccagcgcaucaucaccaucggcacgaucugccugaucguggggaucaucagccuccugcugcagaucggcaacaucauccuccuguggaugucccacagcauccagaccggggagaagucccaccccaaggucugcaaccagagcgugaucaccuacgagaacaacaccugggugaaccagacguacgucaacaucuccaacaccaacaucgccgccggccagggggugaccccgaucauccuggcgggcaacagcucccucugccccaucagcggcugggccaucuacuccaaggacaacagcauccggaucggguccaagggcgacaucuucgugaugcgcgagcccuucaucagcugcucccaccuggagugccggaccuucuuccugacgcagggggcccuccugaacgaccgccacagcaacggcaccgucaaggaccggucccccuaccgcacccugaugagcugcccgaucggggaggcccccucccccuacaacagccgguucgaguccguggccuggagcgcgagcgccugccacgacggcaugggcuggcucaccaucgggaucuccggccccgacaacggggccguggccguccugaaguacaacggcaucaucacggacaccaucaagagcuggcgcaacaagauccugcggacccaggaguccgagugcgugugcaucaacggcagcugcuucaccaucaugacggacgggccguccaacggccaggcgagcuacaagcuguucaagauggagaaggggaagaucauccgcuccaucgagcucgacgcccccaacuaccacuacgaggagugcagcugcuaccccgacaccggcaagguggucugcgugugccgggacaacuggcacgccuccaaccgccccugggugagcuucgaccagaaccuggacuaccagaucggguacaucugcuccggcgucuucggcgacaacccgcggagcaacgacgggaagggcaacugcgggcccgugcucuccaacggcgccaacggggugaagggcuucagcuuccgcuacggcaacggggucuggaucggccggaccaaguccaucagcucccgcagcggguucgagaugaucugggaccccaacggcuggaccgagacggacuccagcuucagcaugaagcaggacaucaucgcccugaccgacugguccggguacagcggcuccuucgugcagcaccccgagcugaccggcaugaacugcauccggccgugcuucuggguggagcucauccgcgggcagcccaaggagagcaccaucuggacguccggcagcuccaucagcuucugcggggucaacuccggcaccgcgagcugguccuggcccgacggcgccgaccugcccuucaccaucgacaaguga

SEQ ID NO: 78223 - RNA, 1413 nt, Artificial Sequence; identical to SEQ ID NO: 77640
  derived and/or modified sequence opt1 from neuraminidase__InfluenzaA__ACU80028

SEQ ID NO: 78224 - RNA, 1410 nt, Artificial Sequence; identical to SEQ ID NO: 77607
  derived and/or modified sequence opt1 from neuraminidase__InfluenzaA__ACU80039

SEQ ID NO: 78225 - RNA, 1413 nt, Artificial Sequence; identical to SEQ ID NO: 77724
  derived and/or modified sequence opt1 from neuraminidase__InfluenzaA__ACU80050

SEQ ID NO: 78226 - RNA, 1410 nt, Artificial Sequence; identical to SEQ ID NO: 78157
  derived and/or modified sequence opt1 from neuraminidase__InfluenzaA__ACU80061

SEQ ID NO: 78227 - RNA, 1413 nt, Artificial Sequence; identical to SEQ ID NO: 77640
  derived and/or modified sequence opt1 from neuraminidase__InfluenzaA__ACU80072

SEQ ID NO: 78228 - RNA, 1413 nt, Artificial Sequence; identical to SEQ ID NO: 77640
  derived and/or modified sequence opt1 from neuraminidase__InfluenzaA__ACU80094

SEQ ID NO: 78229 - RNA, 1410 nt, Artificial Sequence; identical to SEQ ID NO: 77611
  derived and/or modified sequence opt1 from neuraminidase__InfluenzaA__ACU80105

SEQ ID NO: 78230 - RNA, 1410 nt, Artificial Sequence; identical to SEQ ID NO: 77611
  derived and/or modified sequence opt1 from neuraminidase__InfluenzaA__ACU80127

SEQ ID NO: 78231 - RNA, 1410 nt, Artificial Sequence; identical to SEQ ID NO: 77611
  derived and/or modified sequence opt1 from neuraminidase__InfluenzaA__ACU80138

SEQ ID NO: 78232 - RNA, 1410 nt, Artificial Sequence; identical to SEQ ID NO: 77607
  derived and/or modified sequence opt1 from neuraminidase__InfluenzaA__ACU80160

SEQ ID NO: 78233 - RNA, 1413 nt, Artificial Sequence; identical to SEQ ID NO: 77640
  derived and/or modified sequence opt1 from neuraminidase__InfluenzaA__ACU80171

SEQ ID NO: 78234 - RNA, 1410 nt, Artificial Sequence; identical to SEQ ID NO: 77520
  derived and/or modified sequence opt1 from neuraminidase__InfluenzaA__ACU80182

SEQ ID NO: 78235 - RNA, 1410 nt, Artificial Sequence
  derived and/or modified sequence opt1 from neuraminidase__InfluenzaA__ACU80193
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcgaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 78236 - RNA, 1410 nt, Artificial Sequence; identical to SEQ ID NO: 77520
  derived and/or modified sequence opt1 from neuraminidase__InfluenzaA__ACU80204

SEQ ID NO: 78237 - RNA, 1413 nt, Artificial Sequence
  derived and/or modified sequence opt1 from neuraminidase__InfluenzaA__ACU80237
augaaccccaaccagaagaucaucaccaucggcagcaucuccaucgccaucgggaucaucagccugaugcuccagaucggcaacaucaucuccaucugggccagccacuccauccagaccgggaaccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggagcuccaucagcuucugcggcgucaacuccgacacggccaacuggagcuggcccgacggggccgagcugcccuucaccaucgacaaguga

SEQ ID NO: 78238 - RNA, 1410 nt, Artificial Sequence; identical to SEQ ID NO: 77611
  derived and/or modified sequence opt1 from neuraminidase__InfluenzaA__ACU80248

SEQ ID NO: 78239 - RNA, 1410 nt, Artificial Sequence; identical to SEQ ID NO: 77611
  derived and/or modified sequence opt1 from neuraminidase__InfluenzaA__ACU80259

SEQ ID NO: 78240 - RNA, 1413 nt, Artificial Sequence
  derived and/or modified sequence opt1 from neuraminidase__InfluenzaA__ACU80270
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccagcaucgucaugugcgugugccgggacaacuggcacggcuccaaccgccccugggugagcuucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacggggcuggacugcauccggcccugcuucugggucgagcuggugcgcggccucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 78241 - RNA, 1413 nt, Artificial Sequence
  derived and/or modified sequence opt1 from neuraminidase__InfluenzaA__ACU80281
augaaccagaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagcccuucaucuccugcagccaccucgagugccggacguucuuccugacccagggggcccugcucaacgacaagcacuccaacggcaccgucaaggaccgcagcccguaccgggcccugauguccugcccccugggggaggcgcccagccccuacaacagcaaguucgaguccguggccuggagcgccuccgccugccacgacggcaugggcuggcucaccaucgggaucagcggcccggacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuaccccgacaccggcaucgucaugugcgugugccgggacaacuggcacgggagcaaccgcccguggguguccuucaaccagaaccuggacuaccagaucggcuacaucugcagcggcgucuucggggacaacccccggcccgaggacggcgagggguccugcaaccccgugaccguggacggcgcgaacggggucaagggcuucagcuacaaguacgacaacggcguguggaucgggcgcacgaaguccaaccggcugcgcaagggcuucgagaugaucugggacccgaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccccgggagaacaccaccaucuggaccagcggguccagcaucuccuucugcggcgucaacagcgacacggccaacugguccuggccggacggggccgagcugcccuucaccaucgacaaguga

SEQ ID NO: 78242 - RNA, 1410 nt, Artificial Sequence
  derived and/or modified sequence opt1 from neuraminidase__InfluenzaA__ACU80303
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaaggagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcgggaacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 78243 - RNA, 1410 nt, Artificial Sequence; identical to SEQ ID NO: 77611
  derived and/or modified sequence opt1 from neuraminidase__InfluenzaA__ACU80314

SEQ ID NO: 78244 - RNA, 1410 nt, Artificial Sequence; identical to SEQ ID NO: 77611
  derived and/or modified sequence opt1 from neuraminidase__InfluenzaA__ACU80325

SEQ ID NO: 78245 - RNA, 1410 nt, Artificial Sequence; identical to SEQ ID NO: 77607
  derived and/or modified sequence opt1 from neuraminidase__InfluenzaA__ACU80336

SEQ ID NO: 78246 - RNA, 1410 nt, Artificial Sequence; identical to SEQ ID NO: 77611
  derived and/or modified sequence opt1 from neuraminidase__InfluenzaA__ACU80347

SEQ ID NO: 78247 - RNA, 1410 nt, Artificial Sequence; identical to SEQ ID NO: 77611
  derived and/or modified sequence opt1 from neuraminidase__InfluenzaA__ACU80358

SEQ ID NO: 78248 - RNA, 1410 nt, Artificial Sequence; identical to SEQ ID NO: 77611
  derived and/or modified sequence opt1 from neuraminidase__InfluenzaA__ACU80369

SEQ ID NO: 78249 - RNA, 1410 nt, Artificial Sequence; identical to SEQ ID NO: 77611
  derived and/or modified sequence opt1 from neuraminidase__InfluenzaA__ACU80380

SEQ ID NO: 78250 - RNA, 1410 nt, Artificial Sequence
  derived and/or modified sequence opt1 from neuraminidase__InfluenzaA__ACU80391
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccaucaucgagaaggagaucugccccaagcuggccgaguaccggaacugguccaagccccagugcgacaucacgggguucgcgccguucagcaaggacaacuccauccgccugagcgccggcggggacaucugggucacccgggagcccuacguguccugcgaccccgacaagugcuaccaguucgcccucggccaggggaccacccugaacaacgugcacagcaacaacacgguccgcgaccggacccccuaccgcacccugcucaugaacgagcugggcgugccguuccaccugggcaccaagcaggucugcaucgccugguccagcuccagcugccacgacgggaaggccuggcuccacgugugcaucacgggcgacgacaagaacgcgaccgccuccuucaucuacaacgggcggcugguggacagcaucguguccuggagcaaggagauccugcgcacccaggaguccgagugcgucugcaucaacgggaccugcacgguggugaugaccgacgggagcgccagcggcaaggccgacaccaagauccucuucaucgaggagggcaagaucguccacaccuccacgcugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcggccacggggugaagggcugggccuucgacgacgggaacgacgucuggaugggccgcaccaucuccgagaagucccggcugggcuacgagaccuucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagacggaggugcuguggaccagcaacuccaucguggucuucugcggcaccagcgggaccuacggcacgggguccuggcccgacggcgccgacaucaaccugaugccgaucuga

SEQ ID NO: 78251 - RNA, 1410 nt, Artificial Sequence; identical to SEQ ID NO: 77607
  derived and/or modified sequence opt1 from neuraminidase__InfluenzaA__ACU80402

SEQ ID NO: 78252 - RNA, 1413 nt, Artificial Sequence; identical to SEQ ID NO: 77640
  derived and/or modified sequence opt1 from neuraminidase__InfluenzaA__ACU80413

SEQ ID NO: 78253 - RNA, 1410 nt, Artificial Sequence; identical to SEQ ID NO: 77611
  derived and/or modified sequence opt1 from neuraminidase__InfluenzaA__ACU80427

SEQ ID NO: 78254 - RNA, 1410 nt, Artificial Sequence; identical to SEQ ID NO: 77611
  derived and/or modified sequence opt1 from neuraminidase__InfluenzaA__ACU80438

SEQ ID NO: 78255 - RNA, 1410 nt, Artificial Sequence; identical to SEQ ID NO: 77607
  derived and/or modified sequence opt1 from neuraminidase__InfluenzaA__ACU80461

SEQ ID NO: 78256 - RNA, 1410 nt, Artificial Sequence; identical to SEQ ID NO: 77611
  derived and/or modified sequence opt1 from neuraminidase__InfluenzaA__ACU80603

SEQ ID NO: 78257 - RNA, 1410 nt, Artificial Sequence; identical to SEQ ID NO: 77611
  derived and/or modified sequence opt1 from neuraminidase__InfluenzaA__ACU80614

SEQ ID NO: 78258 - RNA, 1410 nt, Artificial Sequence; identical to SEQ ID NO: 77611
  derived and/or modified sequence opt1 from neuraminidase__InfluenzaA__ACU80625

SEQ ID NO: 78259 - RNA, 1410 nt, Artificial Sequence; identical to SEQ ID NO: 77607
  derived and/or modified sequence opt1 from neuraminidase__InfluenzaA__ACU80636

SEQ ID NO: 78260 - RNA, 1410 nt, Artificial Sequence
  derived and/or modified sequence opt1 from neuraminidase__InfluenzaA__ACU80647
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 78261 - RNA, 1410 nt, Artificial Sequence
  derived and/or modified sequence opt1 from neuraminidase__InfluenzaA__ACU80658
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccaagaucaucgagcgcaacaucacggagaucguguaccucaccaacaccaccaucgagaaggagaucugccccaagcuggccgaguaccggaacuggagcaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 78262 - RNA, 1410 nt, Artificial Sequence; identical to SEQ ID NO: 77520
  derived and/or modified sequence opt1 from neuraminidase__InfluenzaA__ACU80669

SEQ ID NO: 78263 - RNA, 1410 nt, Artificial Sequence; identical to SEQ ID NO: 77607
  derived and/or modified sequence opt1 from neuraminidase__InfluenzaA__ACU80691

SEQ ID NO: 78264 - RNA, 1410 nt, Artificial Sequence; identical to SEQ ID NO: 77611
  derived and/or modified sequence opt1 from neuraminidase__InfluenzaA__ACU80702

SEQ ID NO: 78265 - RNA, 1410 nt, Artificial Sequence; identical to SEQ ID NO: 77611
  derived and/or modified sequence opt1 from neuraminidase__InfluenzaA__ACU80713

SEQ ID NO: 78266 - RNA, 1410 nt, Artificial Sequence; identical to SEQ ID NO: 77607
  derived and/or modified sequence opt1 from neuraminidase__InfluenzaA__ACU80724

SEQ ID NO: 78267 - RNA, 1410 nt, Artificial Sequence; identical to SEQ ID NO: 77520
  derived and/or modified sequence opt1 from neuraminidase__InfluenzaA__ACU80735

SEQ ID NO: 78268 - RNA, 1410 nt, Artificial Sequence; identical to SEQ ID NO: 77607
  derived and/or modified sequence opt1 from neuraminidase__InfluenzaA__ACU80746

SEQ ID NO: 78269 - RNA, 1410 nt, Artificial Sequence
  derived and/or modified sequence opt1 from neuraminidase__InfluenzaA__ACU80757
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagguggucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 78270 - RNA, 1410 nt, Artificial Sequence; identical to SEQ ID NO: 78235
  derived and/or modified sequence opt1 from neuraminidase__InfluenzaA__ACU80768

SEQ ID NO: 78271 - RNA, 1410 nt, Artificial Sequence; identical to SEQ ID NO: 77607
  derived and/or modified sequence opt1 from neuraminidase__InfluenzaA__ACU80779

SEQ ID NO: 78272 - RNA, 1410 nt, Artificial Sequence; identical to SEQ ID NO: 77520
  derived and/or modified sequence opt1 from neuraminidase__InfluenzaA__ACU80790

SEQ ID NO: 78273 - RNA, 1410 nt, Artificial Sequence; identical to SEQ ID NO: 77607
  derived and/or modified sequence opt1 from neuraminidase__InfluenzaA__ACU80801

SEQ ID NO: 78274 - RNA, 1410 nt, Artificial Sequence
  derived and/or modified sequence opt1 from neuraminidase__InfluenzaA__ACU81106
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaacagcuccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 78275 - RNA, 1410 nt, Artificial Sequence; identical to SEQ ID NO: 77901
  derived and/or modified sequence opt1 from neuraminidase__InfluenzaA__ACU87265

SEQ ID NO: 78276 - RNA, 1410 nt, Artificial Sequence; identical to SEQ ID NO: 77746
  derived and/or modified sequence opt1 from neuraminidase__InfluenzaA__ACU87273

SEQ ID NO: 78277 - RNA, 1410 nt, Artificial Sequence; identical to SEQ ID NO: 77746
  derived and/or modified sequence opt1 from neuraminidase__InfluenzaA__ACV04231

SEQ ID NO: 78278 - RNA, 1410 nt, Artificial Sequence; identical to SEQ ID NO: 77746
  derived and/or modified sequence opt1 from neuraminidase__InfluenzaA__ACV04241

SEQ ID NO: 78279 - RNA, 1410 nt, Artificial Sequence; identical to SEQ ID NO: 77746
  derived and/or modified sequence opt1 from neuraminidase__InfluenzaA__ACV04251

SEQ ID NO: 78280 - RNA, 1410 nt, Artificial Sequence; identical to SEQ ID NO: 77746
  derived and/or modified sequence opt1 from neuraminidase__InfluenzaA__ACV04261

SEQ ID NO: 78281 - RNA, 1410 nt, Artificial Sequence; identical to SEQ ID NO: 77746
  derived and/or modified sequence opt1 from neuraminidase__InfluenzaA__ACV04271

SEQ ID NO: 78282 - RNA, 1410 nt, Artificial Sequence
  derived and/or modified sequence opt1 from neuraminidase__InfluenzaA__ACV04281
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucggcaacacgaacuucgccgcggggcaguccgucgugagcgugaagcuggccggcaacuccagccucugcccggucuccggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacucccgguucgagagcguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcgacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 78283 - RNA, 1410 nt, Artificial Sequence; identical to SEQ ID NO: 77746
  derived and/or modified sequence opt1 from neuraminidase__InfluenzaA__ACV04291

SEQ ID NO: 78284 - RNA, 1410 nt, Artificial Sequence; identical to SEQ ID NO: 77746
  derived and/or modified sequence opt1 from neuraminidase__InfluenzaA__ACV04301

SEQ ID NO: 78285 - RNA, 1410 nt, Artificial Sequence; identical to SEQ ID NO: 77746
  derived and/or modified sequence opt1 from neuraminidase__InfluenzaA__ACV04321

SEQ ID NO: 78286 - RNA, 1410 nt, Artificial Sequence; identical to SEQ ID NO: 77746
  derived and/or modified sequence opt1 from neuraminidase__InfluenzaA__ACV04331

SEQ ID NO: 78287 - RNA, 1410 nt, Artificial Sequence; identical to SEQ ID NO: 77746
  derived and/or modified sequence opt1 from neuraminidase__InfluenzaA__ACV04341

SEQ ID NO: 78288 - RNA, 1410 nt, Artificial Sequence; identical to SEQ ID NO: 77746
  derived and/or modified sequence opt1 from neuraminidase__InfluenzaA__ACV04351

SEQ ID NO: 78289 - RNA, 1410 nt, Artificial Sequence; identical to SEQ ID NO: 77746
  derived and/or modified sequence opt1 from neuraminidase__InfluenzaA__ACV04361

SEQ ID NO: 78290 - RNA, 1410 nt, Artificial Sequence; identical to SEQ ID NO: 77746
  derived and/or modified sequence opt1 from neuraminidase__InfluenzaA__ACV04371

SEQ ID NO: 78291 - RNA, 1410 nt, Artificial Sequence; identical to SEQ ID NO: 77746
  derived and/or modified sequence opt1 from neuraminidase__InfluenzaA__ACV04381

SEQ ID NO: 78292 - RNA, 1410 nt, Artificial Sequence; identical to SEQ ID NO: 77746
  derived and/or modified sequence opt1 from neuraminidase__InfluenzaA__ACV04391

SEQ ID NO: 78293 - RNA, 1410 nt, Artificial Sequence; identical to SEQ ID NO: 77746
  derived and/or modified sequence opt1 from neuraminidase__InfluenzaA__ACV04401

SEQ ID NO: 78294 - RNA, 1410 nt, Artificial Sequence; identical to SEQ ID NO: 77736
  derived and/or modified sequence opt1 from neuraminidase__InfluenzaA__ACV04411

SEQ ID NO: 78295 - RNA, 1410 nt, Artificial Sequence; identical to SEQ ID NO: 77746
  derived and/or modified sequence opt1 from neuraminidase__InfluenzaA__ACV04492

SEQ ID NO: 78296 - RNA, 1410 nt, Artificial Sequence; identical to SEQ ID NO: 77746
  derived and/or modified sequence opt1 from neuraminidase__InfluenzaA__ACV04502

SEQ ID NO: 78297 - RNA, 1410 nt, Artificial Sequence; identical to SEQ ID NO: 77736
  derived and/or modified sequence opt1 from neuraminidase__InfluenzaA__ACV04512

SEQ ID NO: 78298 - RNA, 1410 nt, Artificial Sequence
  derived and/or modified sequence opt1 from neuraminidase__InfluenzaA__ACV04522
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggcaagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78299 - RNA, 1410 nt, Artificial Sequence; identical to SEQ ID NO: 77746
  derived and/or modified sequence opt1 from neuraminidase__InfluenzaA__ACV04532

SEQ ID NO: 78300 - RNA, 1410 nt, Artificial Sequence; identical to SEQ ID NO: 77746
  derived and/or modified sequence opt1 from neuraminidase__InfluenzaA__ACV04542

SEQ ID NO: 78301 - RNA, 1410 nt, Artificial Sequence; identical to SEQ ID NO: 77746
  derived and/or modified sequence opt1 from neuraminidase__InfluenzaA__ACV04552

SEQ ID NO: 78302 - RNA, 1410 nt, Artificial Sequence; identical to SEQ ID NO: 77746
  derived and/or modified sequence opt1 from neuraminidase__InfluenzaA__ACV04562

SEQ ID NO: 78303 - RNA, 1410 nt, Artificial Sequence; identical to SEQ ID NO: 77736
  derived and/or modified sequence opt1 from neuraminidase__InfluenzaA__ACV04572

SEQ ID NO: 78304 - RNA, 1410 nt, Artificial Sequence; identical to SEQ ID NO: 77746
  derived and/or modified sequence opt1 from neuraminidase__InfluenzaA__ACV04582

SEQ ID NO: 78305 - RNA, 1410 nt, Artificial Sequence
  derived and/or modified sequence opt1 from neuraminidase__InfluenzaA__ACV04758
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcucccccagcgagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcugaccaucggcaucagcggccccgacaacggggccguggccguccucaaguacaacggcaucaucaccgacaccaucaaguccuggcgcaacaacauccugcggacgcaggagagcgagugcgcgugcgugaacggguccugcuucaccgugaugaccgacggcccgagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcucacgggccuggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 78306 - RNA, 1410 nt, Artificial Sequence; identical to SEQ ID NO: 77736
  derived and/or modified sequence opt1 from neuraminidase__InfluenzaA__ACV33087

SEQ ID NO: 78307 - RNA, 1410 nt, Artificial Sequence; identical to SEQ ID NO: 77746
  derived and/or modified sequence opt1 from neuraminidase__InfluenzaA__ACV33107

SEQ ID NO: 78308 - RNA, 1410 nt, Artificial Sequence; identical to SEQ ID NO: 77746
  derived and/or modified sequence opt1 from neuraminidase__InfluenzaA__ACV33117

SEQ ID NO: 78309 - RNA, 1410 nt, Artificial Sequence; identical to SEQ ID NO: 77746
  derived and/or modified sequence opt1 from neuraminidase__InfluenzaA__ACV33127

SEQ ID NO: 78310 - RNA, 1410 nt, Artificial Sequence; identical to SEQ ID NO: 77746
  derived and/or modified sequence opt1 from neuraminidase__InfluenzaA__ACV33137

SEQ ID NO: 78311 - RNA, 1410 nt, Artificial Sequence; identical to SEQ ID NO: 77746
  derived and/or modified sequence opt1 from neuraminidase__InfluenzaA__ACV33147

SEQ ID NO: 78312 - RNA, 1410 nt, Artificial Sequence
  derived and/or modified sequence opt1 from neuraminidase__InfluenzaA__ACV33157
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccggucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78313 - RNA, 1410 nt, Artificial Sequence
  derived and/or modified sequence opt1 from neuraminidase__InfluenzaA__ACV33167
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgacugguccuggcccgacggggccgagcugccguucacgaucgacaaguga

SEQ ID NO: 78314 - RNA, 1410 nt, Artificial Sequence; identical to SEQ ID NO: 77746
  derived and/or modified sequence opt1 from neuraminidase__InfluenzaA__ACV33177

SEQ ID NO: 78315 - RNA, 1410 nt, Artificial Sequence
  derived and/or modified sequence opt1 from neuraminidase__InfluenzaA__ACV41993
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagaucugcaaccagagcgucaucacguacgagaacaacaccugggugaaccagaccuacgugaacaucuccaacaccaacuucgccgcgggccagagcgucguguccgugaagcuggccgggaacagcucccucugcccggucggcggcugggccaucuacagcaaggacaacuccgugcgcaucgggagcaagggcgacguguucgucauccgggagcccuucaucuccugcagcccccuggagugccgcacguucuuccugacccagggggcccuccugaacgacaagcacuccaacggcaccaucaaggaccggagccccuaccgcacccugauguccugcccgaucggggaggugcccagccccuacaacucccgguucgagagcguggccuggagcgcguccgccugccacgacggcaucaacuggcucacgaucggcaucagcgggcccgacaacggcgccgucgccgugcugaaguacaacgggaucaucaccgacaccaucaaguccuggcgcaacaacauccugcggacccaggagagcgagugcgcgugcgugaacggcuccugcuucacggucaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcacccggagcugaccggccuggacugcauccgccccugcuucuggguggagcucauccgggggcgccccaaggagaacacgaucuggaccuccggcagcuccaucagcuucugcggggucaacuccgacaccgugggcuggagcuggcccgacggcgccgagcugccguucaccaucgacaaguga

SEQ ID NO: 78316 - RNA, 1410 nt, Artificial Sequence; identical to SEQ ID NO: 77746
  derived and/or modified sequence opt1 from neuraminidase__InfluenzaA__ACV42010

SEQ ID NO: 78317 - RNA, 1410 nt, Artificial Sequence; identical to SEQ ID NO: 77746
  derived and/or modified sequence opt1 from neuraminidase__InfluenzaA__ACV42020

SEQ ID NO: 78318 - RNA, 1410 nt, Artificial Sequence; identical to SEQ ID NO: 77511
  derived and/or modified sequence opt1 from neuraminidase__InfluenzaA__ACV49504

SEQ ID NO: 78319 - RNA, 1362 nt, Artificial Sequence
  derived and/or modified sequence opt1 from neuraminidase__InfluenzaA__ACV49537
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccaggggaucaucaccuacaacgugguggccggccaggacuccaccagcgucauccugaccggcaacuccagccugugcccgauccgcgggugggccauccacuccaaggacaacggcauccggaucgggagcaagggcgacguguucgugauccgcgagcccuucaucuccugcagccaccucgagugccggacguucuuccugacccagggggcgcugcucaacgacaagcacuccaacggcgccgucaaggaccgcagccccuaccgggcccugauguccugccccgugggcgaggccccgagccccuacaacucccgcuucgagagcguggccugguccgcgagcgccugccacgacgggaugggcuggcugaccaucgggaucagcggccccgacaacggcgccgucgccgugcucaaguacaacgggaucaucaccgagacgaucaaguccuggcggaagaagauccugcgcacccaggagagcgagugcacgugcgugaacggcuccugcuucaccaucaugaccgacgggcccagcgacggccuggcguccuacaagaucuucaagaucgagaaggggaaggucaccaagagcaucgagcucaacgccccgaacucccacuacgaggagugcagcugcuaccccgacaccggcaaggugaugugcgugugccgggacaacuggcacggcuccaaccgccccugggucagcuucgaccagaaccuggacuaccagaucggguacaucugcuccggcguguucggggacaacccccggccgaaggacggcaccgggagcugcggccccguguccgccgacggcgccaacggggucaagggcuucagcuaccgcuacgggaacggcguguggaucgggcggacgaaguccgacagcucccgccacggcuucgagaugaucugggaccccaacggcuggaccgagaccgacagccgguucuccgugcgccaggacgucguggccaugaccgaccggagcggguacagcggcuccuucgugcagcaccccgagcugacggggcucgacugcaugcgcccgugcuucugggucgagcugauccggggccgccccgaggagaagaccaucuggaccagcggcuccaucaucagcuucugcggggugaacuccgacaccgucgacuggagcuggcccgacggcgcggagcugcccuucacgaucgacaaguga

SEQ ID NO: 78320 - RNA, 1362 nt, Artificial Sequence
  derived and/or modified sequence opt1 from neuraminidase__InfluenzaA__ACV49559
augaaccccaaccagaagaucaucaccaucggcagcaucugcaugguggucgggaucaucucccugauccuccagaucggcaacaucaucagcaucuggaucucccacagcauccaggccggguccagcaccugggugaaccagacguacgugaacaucuccaacaccaacgucguggccggccaggacgcgaccagcgugauccugaccgggaacuccagccugugcccgauccgcggcugggccaucuacuccaaggacaacggcauccggaucgggagcaagggcgacaucuucgucauccgcgagcccuucaucuccugcagccaccucgagugccgggccuucuuccugacgcagggggcccugcucaacgacaagcacuccaacggcaccgugaaggaccgcagccccuaccgggcccugauguccugccccgugggggaggcgccgagccccuacaacucccgcuucgagagcgucgccuggagcgccuccgccugccacgacggcaugggcuggcugaccaucgggaucagcggccccgacaacggggcgguggccgugcucaaguacaacggcaucaucaccgagacgaucaaguccuggcggaagaagauccugcgcacccaggagagcgagugcgccugcgucaacggcuccugcuucaccaucaugaccgacgggcccagcgacggcccggccuccuacaagaucuucaagaucgagaaggggaaggugaccaagagcaucgagcuggacgcccccaacucccacuacgaggagugcagcugcuaccccgacacgggcaaggugaugugcgucugccgggacaacuggcacggguccaaccgccccugggugagcuucgaccagaaccucgacuaccagaucggcuacaucugcuccggcguguucggggacaccccgcggcccaaggacggcaccgggagcugcggccccgucuccguggacggggcgaacggcgugaagggcuucagcuaccgcuacggggacggcgucuggaucgggcggacgaagucccagagcucccgccacggcuucgagaugaucugggaccccaacggguggaccgagaccgacagccgguucagcgugcgccaggacguggucgccaucaccgacugguccggcuacagcggcuccuucgugcagcacccggagcugacggggcuggacugcaugcggcccugcuucugggucgagcucauccgcggccagcccaaggagaagaccaucuggaccagcggguccagcaucuccuucugcggcgugaacagcgacaccguggacugguccuggcccgacggcgccgagcugccguucacgaucgacaaguga

SEQ ID NO: 78321 - RNA, 1395 nt, Artificial Sequence
  derived and/or modified sequence opt1 from neuraminidase__InfluenzaA__ACV49570
augaaccccaaccagaagaucaucaccaucggcagcaucugcaugguggucgggaucaucucccugauccuccagaucggcaacaucgugagcaucuggaucucccacagcauccagaccgggaaccagaaccacacggggaccugcgaccaguccaucaucaccuacaagaacagcaccugggugaaccagacguacgucaacgugguggccggcaaggacaccaccuccgucauccuggccggcaacagcucccugugcccgauccgcggcugggcgaucuacagcaaggacaacggggugcggaucggcuccaagggggacguguucgucauccgcgagcccuucaucagcugcucccaccucgagugccggaccuucuuccugacgcagggcgcccugcucaacgacaagcacagcaacgggaccgugaaggaccgcucccccuaccgggcccugaugagcugccccgugggcgaggccccgucccccuacaacagccgcuucgaguccgucgccuggagcgcgagcgccugccacgacggcaugggguggcugaccaucggcaucuccgggcccgacgacggcgccguggccgugcucaaguacaacggcaucaucaccgagacgaucaagagcuggcggaaggagauccugcgcacccaggaguccgagugcgucugcgugaacgggagcugcuucaccaucaugaccgacggccccuccgggggcccggcgagcuacaagaucuucaagaucgagaaggggaaggugacgaaguccaucgagcuggacgcccccaacagccacuacgaggagugcuccugcuaccccgacaccagcaaggucaugugcgugugccgggacaacuggcacggcuccaaccgccccugggugagcuucgaccagaaccucgacuaccagaugggcuacaucugcuccggggucuucggcgacaacccgcggcccaaggacgggaagggcagcugcgggcccguguacguggacggcgccaacggcgucaagggguucuccuacaaguacggcaacgggguguggaucggccgcaccaagagcaacuccagccggcagggguucgagaugaucugggaccccaacggcuggaccgagacggacuccaacuucuucaccaagcaggacgucguggccgugaccgacuggagcggcuacagcggguccuucguccagcacccggagcugaccggccuggacugcaugcgccccugcuucuggguggagcucauccgggggcgccccaaggagaacacgaucuggaccagcggcuccagcaucuccuucugcggcgugaacagcgacaccgucgacugguccuggcccgacggggccgagcugccguucaccaucgacaaguga

SEQ ID NO: 78322 - RNA, 1410 nt, Artificial Sequence; identical to SEQ ID NO: 77412
  derived and/or modified sequence opt1 from neuraminidase__InfluenzaA__ACV49581

SEQ ID NO: 78323 - RNA, 1410 nt, Artificial Sequence; identical to SEQ ID NO: 77412
  derived and/or modified sequence opt1 from neuraminidase__InfluenzaA__ACV49592

SEQ ID NO: 78324 - RNA, 1410 nt, Artificial Sequence
  derived and/or modified sequence opt1 from neuraminidase__InfluenzaA__ACV49603
augaaccccaaccagaagaucaucaccaucggcagcgugucccugaccaucgagacggucugcuuccucaugcagaucgccauccuggccaccaccgugacccugcacuucaagcagcacgagugcgacagcccggcguccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccagcuccugccacgacgggaaggcguggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgccagcggccgggcggacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggacagccgguccggguacgagaccuucaaggucaucggcggguggagcacccccaacuccaagagccaggugaaccgccaggucaucguggacaacaacaacugguccggcuacagcgggaucuucagcguggagggcaaguccugcaucaaccggugcuucuacgucgagcugauccgcggccgcccccaggagacccgggugugguggaccagcaacuccaucguggucuucugcgggaccagcggcacguacgggaccggcuccuggcccgacggggccaacaucaacuucaugccgaucuga

SEQ ID NO: 78325 - RNA, 1410 nt, Artificial Sequence
  derived and/or modified sequence opt1 from neuraminidase__InfluenzaA__ACV49625
augaaccccaaccagaagaccaucaccaucggcagcgugucccugacgaucgagaccgucugcuuccucaugcagaucgccauccuggccaccaccgugacgcugcacuucaagcagcacgagugcgacagcccggcguccaaccaggugaugcccugcgagcccaucaucaucgagcgcaacaucaccgagaucgucuaccucaacaacaccaccaucgagaaggagaucugccccgaggugguggaguaccggaacuggagcaagccgcagugccagaucacgggguucgcccccuucuccaaggacaacagcauccgccuguccgccggcggggacaucugggucacccggggccccuacgugagcugcgaccccgggaagugcuaccaguucgcccugggccagggcaccacccucgacaacaagcacuccaacgggacgauccacgaccgcaucccgcaccggacccugcugaugaacgagcucggcgugcccuuccaccuggggaccaagcaggucugcguggccuggagcuccagcuccugccacgacggcaaggcguggcugcacgugugcgucaccggggacgaccgcaacgccacggccagcuucaucuacgacggccggcucguggacuccaucggcagcuggucccagaacauccugcgcacccaggagagcgagugcgugugcaucaacgggaccugcaccgucgugaugacggacggcuccgccagcgggcgggcggacacccgcauccuguucaucaaggagggcaagaucgugcacaucagcccccucuccggcagcgcccagcacaucgaggagugcuccugcuacccccgguacccggacguccgcugcaucugccgggacaacuggaaggggagcaaccgccccgugaucgacaucaacauggaggacuacuccaucgacagcuccuacgugugcagcggccuggucggggacacgccccggaacgacgacuccagcuccaacagcaacugccgcgaccccaacaacgagcggggcaacccgggggugaagggcugggccuucgacaacggcgacgacguguggauggggcgcaccaucuccaaggacagccgguccggcuacgagaccuucaaggucaucgggggcuggagcacccccaacuccaagagccaggugaaccgccaggucaucguggacaacaacaacugguccggguacagcggcaucuucagcguggagggcaaguccugcaucaaccggugcuucuacgucgagcugauccgcgggcgcccccaggagacccgggugugguggaccagcaacuccaucguggucuucugcggcacgagcgggaccuacggcaccggguccuggcccgacggcgccaacaucaacuucaugccgaucuga

SEQ ID NO: 78326 - RNA, 1410 nt, Artificial Sequence; identical to SEQ ID NO: 77464
  derived and/or modified sequence opt1 from neuraminidase__InfluenzaA__ACV49647

SEQ ID NO: 78327 - RNA, 1413 nt, Artificial Sequence
  derived and/or modified sequence opt1 from neuraminidase__InfluenzaA__ACV49669
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccgugacccuggcgggcaacagcucccugugcccgaucagcggcugggccaucuacuccaaggacaacagcauccggaucggguccaagggcgacguguucgucauccgcgagcccuucaucagcugcucccaccucgagugccggacguucuuccugacccagggggcccugcucaacgacaagcacagcaacggcaccgugaaggaccgcucccccuaccgggcccugaugagcugccccaucggggaggccccgucccccuacaacagccgcuucgagagcguggcgugguccgccagcgccugccacgacggcaugggcuggcugaccaucgggaucuccggccccgacgacggggccgucgcggugcucaaguacaacggcaucaucacggagaccaucaagagcuggcggaagcgcauccugcggacccaggaguccgagugcgugugcgucaacggcagcugcuucaccaucaugacggacgggcccaacaacggcccggccuccuacaagaucuucaagaucgagaaggggaagaucaccaagagcaucgagcuggacgcccccaacucccacuacgaggagugcagcugcuaccccgacgccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcggccccgugaccgucgacggggccgacggcgugaagggcuucuccuaccgguacgggaacggcguguggaucgggcgcaccaagagcaacuccagccggcgcggcuucgagaugaucugggaccccaacggguggacggacaccgacuccaaguuccuggucaagcaggacgugguggcgaugaccgacuggagcggcuacagcggcuccuucguccagcacccggagcugacggggcucgacugcaugcggcccugcuucuggguggagcugauccgcggccggccccgcgagaacaccaccaucuggaccagcggguccagcaucuccuucugcggcgucaacggcgacacggccaacuggagcuggcccgacggggccgagcugccguucaccaucgacaaguga

SEQ ID NO: 78328 - RNA, 1413 nt, Artificial Sequence
  derived and/or modified sequence opt1 from neuraminidase__InfluenzaA__ACV49679
augaaccccaaccagaagaucaucaccaucggcagcaucuccaucgccaucgggaucaucagccugaugcuccagaucggcuccaucaucagcaucugggccucccacagcauccgcaccgggucccagaacaacacgggcaucugcaaccagcggaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccgccccugcuucugggucgagcuggugcgggggcucccgcgcgagaacaccaccaucuggaccuccggcagcuccaucagcuucugcggggucaacuccgacacggccaacuggagcuggcccgacggcgccgagcugcccuucaccaucgacaaguga

SEQ ID NO: 78329 - RNA, 1410 nt, Artificial Sequence
  derived and/or modified sequence opt1 from neuraminidase__InfluenzaA__ACV53442
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78330 - RNA, 1410 nt, Artificial Sequence; identical to SEQ ID NO: 78113
  derived and/or modified sequence opt1 from neuraminidase__InfluenzaA__ACV53452

SEQ ID NO: 78331 - RNA, 1410 nt, Artificial Sequence; identical to SEQ ID NO: 77736
  derived and/or modified sequence opt1 from neuraminidase__InfluenzaA__ACV53462

SEQ ID NO: 78332 - RNA, 1410 nt, Artificial Sequence; identical to SEQ ID NO: 77746
  derived and/or modified sequence opt1 from neuraminidase__InfluenzaA__ACV53472

SEQ ID NO: 78333 - RNA, 1410 nt, Artificial Sequence
  derived and/or modified sequence opt1 from neuraminidase__InfluenzaA__ACV53482
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccggcgagaucacgugcgucugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgccaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaaguga

SEQ ID NO: 78334 - RNA, 1410 nt, Artificial Sequence
  derived and/or modified sequence opt1 from neuraminidase__InfluenzaA__ACV53492
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaaggccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuuccugaucaagcaggacaucgugggcaucaacgaguggagcggguacuccggcagcuucgugcagcacccggagcugaccgggcucgacugcauccgccccugcuucugggucgagcugauccggggccgccccaaggagaacacgaucuggaccuccggcagcuccaucagcuucugcggggugaacuccgacaccgucggcuggagcuggcccgacggggcggagcugccguucaccaucgacaaguga

SEQ ID NO: 78335 - RNA, 1410 nt, Artificial Sequence
  derived and/or modified sequence opt1 from neuraminidase__InfluenzaA__ACV53502
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaaggccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuuccugaucaagcaggacaucguggggaucaacgaguggagcggcuacuccgggagcuucgugcagcacccggagcugaccggccucgacugcauccgccccugcuucugggucgagcugauccggggccgccccaaggagaacacgaucuggaccuccgggagcuccaucagcuucugcggcgugaacuccgacaccgucggguggagcuggcccgacggcgcggagcugccguucaccaucgacaaguga

SEQ ID NO: 78336 - RNA, 1410 nt, Artificial Sequence
  derived and/or modified sequence opt1 from neuraminidase__InfluenzaA__ACV53891
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaagauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugcgaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78337 - RNA, 1410 nt, Artificial Sequence
  derived and/or modified sequence opt1 from neuraminidase__InfluenzaA__ACV53901
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagccgcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 78338 - RNA, 1410 nt, Artificial Sequence; identical to SEQ ID NO: 77746
  derived and/or modified sequence opt1 from neuraminidase__InfluenzaA__ACV53911

SEQ ID NO: 78339 - RNA, 1410 nt, Artificial Sequence; identical to SEQ ID NO: 77736
  derived and/or modified sequence opt1 from neuraminidase__InfluenzaA__ACV67088

SEQ ID NO: 78340 - RNA, 1410 nt, Artificial Sequence; identical to SEQ ID NO: 77746
  derived and/or modified sequence opt1 from neuraminidase__InfluenzaA__ACV67168

SEQ ID NO: 78341 - RNA, 1410 nt, Artificial Sequence; identical to SEQ ID NO: 77736
  derived and/or modified sequence opt1 from neuraminidase__InfluenzaA__ACV67169

SEQ ID NO: 78342 - RNA, 1410 nt, Artificial Sequence; identical to SEQ ID NO: 77746
  derived and/or modified sequence opt1 from neuraminidase__InfluenzaA__ACV67171

SEQ ID NO: 78343 - RNA, 1410 nt, Artificial Sequence; identical to SEQ ID NO: 77746
  derived and/or modified sequence opt1 from neuraminidase__InfluenzaA__ACV67172

SEQ ID NO: 78344 - RNA, 1410 nt, Artificial Sequence; identical to SEQ ID NO: 77776
  derived and/or modified sequence opt1 from neuraminidase__InfluenzaA__ACV67173

SEQ ID NO: 78345 - RNA, 1410 nt, Artificial Sequence; identical to SEQ ID NO: 77736
  derived and/or modified sequence opt1 from neuraminidase__InfluenzaA__ACV67174

SEQ ID NO: 78346 - RNA, 1410 nt, Artificial Sequence
  derived and/or modified sequence opt1 from neuraminidase__InfluenzaA__ACV67175
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggguccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78347 - RNA, 1410 nt, Artificial Sequence; identical to SEQ ID NO: 77746
  derived and/or modified sequence opt1 from neuraminidase__InfluenzaA__ACV67176

SEQ ID NO: 78348 - RNA, 1410 nt, Artificial Sequence; identical to SEQ ID NO: 77736
  derived and/or modified sequence opt1 from neuraminidase__InfluenzaA__ACV67177

SEQ ID NO: 78349 - RNA, 1410 nt, Artificial Sequence; identical to SEQ ID NO: 77746
  derived and/or modified sequence opt1 from neuraminidase__InfluenzaA__ACV67178

SEQ ID NO: 78350 - RNA, 1410 nt, Artificial Sequence; identical to SEQ ID NO: 77746
  derived and/or modified sequence opt1 from neuraminidase__InfluenzaA__ACV67179

SEQ ID NO: 78351 - RNA, 1410 nt, Artificial Sequence
  derived and/or modified sequence opt1 from neuraminidase__InfluenzaA__ACV67180
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagccggucgugagcgugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 78352 - RNA, 1410 nt, Artificial Sequence
  derived and/or modified sequence opt1 from neuraminidase__InfluenzaA__ACV67181
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucaucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78353 - RNA, 1410 nt, Artificial Sequence; identical to SEQ ID NO: 78170
  derived and/or modified sequence opt1 from neuraminidase__InfluenzaA__ACV67182

SEQ ID NO: 78354 - RNA, 1410 nt, Artificial Sequence
  derived and/or modified sequence opt1 from neuraminidase__InfluenzaA__ACV67183
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccaacgagaucacgugcgucugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaaguccaucaacagccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78355 - RNA, 1410 nt, Artificial Sequence; identical to SEQ ID NO: 77746
  derived and/or modified sequence opt1 from neuraminidase__InfluenzaA__ACV67184

SEQ ID NO: 78356 - RNA, 1410 nt, Artificial Sequence; identical to SEQ ID NO: 77736
  derived and/or modified sequence opt1 from neuraminidase__InfluenzaA__ACV67186

SEQ ID NO: 78357 - RNA, 1410 nt, Artificial Sequence; identical to SEQ ID NO: 77746
  derived and/or modified sequence opt1 from neuraminidase__InfluenzaA__ACV67187

SEQ ID NO: 78358 - RNA, 1410 nt, Artificial Sequence; identical to SEQ ID NO: 77746
  derived and/or modified sequence opt1 from neuraminidase__InfluenzaA__ACV67188

SEQ ID NO: 78359 - RNA, 1410 nt, Artificial Sequence; identical to SEQ ID NO: 77776
  derived and/or modified sequence opt1 from neuraminidase__InfluenzaA__ACV67189

SEQ ID NO: 78360 - RNA, 1410 nt, Artificial Sequence; identical to SEQ ID NO: 77776
  derived and/or modified sequence opt1 from neuraminidase__InfluenzaA__ACV67190

SEQ ID NO: 78361 - RNA, 1410 nt, Artificial Sequence; identical to SEQ ID NO: 77736
  derived and/or modified sequence opt1 from neuraminidase__InfluenzaA__ACV67191

SEQ ID NO: 78362 - RNA, 1410 nt, Artificial Sequence; identical to SEQ ID NO: 77776
  derived and/or modified sequence opt1 from neuraminidase__InfluenzaA__ACV67192

SEQ ID NO: 78363 - RNA, 1410 nt, Artificial Sequence; identical to SEQ ID NO: 77776
  derived and/or modified sequence opt1 from neuraminidase__InfluenzaA__ACV67193

SEQ ID NO: 78364 - RNA, 1410 nt, Artificial Sequence; identical to SEQ ID NO: 77746
  derived and/or modified sequence opt1 from neuraminidase__InfluenzaA__ACV67194

SEQ ID NO: 78365 - RNA, 1410 nt, Artificial Sequence; identical to SEQ ID NO: 77746
  derived and/or modified sequence opt1 from neuraminidase__InfluenzaA__ACV67195

SEQ ID NO: 78366 - RNA, 1410 nt, Artificial Sequence; identical to SEQ ID NO: 77746
  derived and/or modified sequence opt1 from neuraminidase__InfluenzaA__ACV67196

SEQ ID NO: 78367 - RNA, 1410 nt, Artificial Sequence; identical to SEQ ID NO: 77736
  derived and/or modified sequence opt1 from neuraminidase__InfluenzaA__ACV67197

SEQ ID NO: 78368 - RNA, 1410 nt, Artificial Sequence; identical to SEQ ID NO: 77736
  derived and/or modified sequence opt1 from neuraminidase__InfluenzaA__ACV67199

SEQ ID NO: 78369 - RNA, 1410 nt, Artificial Sequence; identical to SEQ ID NO: 77736
  derived and/or modified sequence opt1 from neuraminidase__InfluenzaA__ACV67200

SEQ ID NO: 78370 - RNA, 1410 nt, Artificial Sequence; identical to SEQ ID NO: 77736
  derived and/or modified sequence opt1 from neuraminidase__InfluenzaA__ACV67201

SEQ ID NO: 78371 - RNA, 1410 nt, Artificial Sequence; identical to SEQ ID NO: 77736
  derived and/or modified sequence opt1 from neuraminidase__InfluenzaA__ACV67202

SEQ ID NO: 78372 - RNA, 1410 nt, Artificial Sequence; identical to SEQ ID NO: 77746
  derived and/or modified sequence opt1 from neuraminidase__InfluenzaA__ACV67203

SEQ ID NO: 78373 - RNA, 1410 nt, Artificial Sequence; identical to SEQ ID NO: 77746
  derived and/or modified sequence opt1 from neuraminidase__InfluenzaA__ACV67204

SEQ ID NO: 78374 - RNA, 1410 nt, Artificial Sequence; identical to SEQ ID NO: 77746
  derived and/or modified sequence opt1 from neuraminidase__InfluenzaA__ACV67205

SEQ ID NO: 78375 - RNA, 1410 nt, Artificial Sequence
  derived and/or modified sequence opt1 from neuraminidase__InfluenzaA__ACV67206
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78376 - RNA, 1410 nt, Artificial Sequence; identical to SEQ ID NO: 77736
  derived and/or modified sequence opt1 from neuraminidase__InfluenzaA__ACV67207

SEQ ID NO: 78377 - RNA, 1410 nt, Artificial Sequence; identical to SEQ ID NO: 77746
  derived and/or modified sequence opt1 from neuraminidase__InfluenzaA__ACV67208

SEQ ID NO: 78378 - RNA, 1410 nt, Artificial Sequence; identical to SEQ ID NO: 77736
  derived and/or modified sequence opt1 from neuraminidase__InfluenzaA__ACV67210

SEQ ID NO: 78379 - RNA, 1410 nt, Artificial Sequence; identical to SEQ ID NO: 77746
  derived and/or modified sequence opt1 from neuraminidase__InfluenzaA__ACV67211

SEQ ID NO: 78380 - RNA, 1410 nt, Artificial Sequence; identical to SEQ ID NO: 77746
  derived and/or modified sequence opt1 from neuraminidase__InfluenzaA__ACV70076

SEQ ID NO: 78381 - RNA, 1410 nt, Artificial Sequence
  derived and/or modified sequence opt1 from neuraminidase__InfluenzaA__ACV70086
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78382 - RNA, 1410 nt, Artificial Sequence
  derived and/or modified sequence opt1 from neuraminidase__InfluenzaA__ACV70096
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucaccgccggccagagcgucguguccgugaagcuggcggggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 78383 - RNA, 1410 nt, Artificial Sequence; identical to SEQ ID NO: 77746
  derived and/or modified sequence opt1 from neuraminidase__InfluenzaA__ACV70106

SEQ ID NO: 78384 - RNA, 1410 nt, Artificial Sequence; identical to SEQ ID NO: 77746
  derived and/or modified sequence opt1 from neuraminidase__InfluenzaA__ACV70116

SEQ ID NO: 78385 - RNA, 1410 nt, Artificial Sequence; identical to SEQ ID NO: 77746
  derived and/or modified sequence opt1 from neuraminidase__InfluenzaA__ACV70126

SEQ ID NO: 78386 - RNA, 1410 nt, Artificial Sequence; identical to SEQ ID NO: 77746
  derived and/or modified sequence opt1 from neuraminidase__InfluenzaA__ACV70157

SEQ ID NO: 78387 - RNA, 1410 nt, Artificial Sequence; identical to SEQ ID NO: 77736
  derived and/or modified sequence opt1 from neuraminidase__InfluenzaA__ACV70167

SEQ ID NO: 78388 - RNA, 1410 nt, Artificial Sequence; identical to SEQ ID NO: 77746
  derived and/or modified sequence opt1 from neuraminidase__InfluenzaA__ACV70177

SEQ ID NO: 78389 - RNA, 1410 nt, Artificial Sequence; identical to SEQ ID NO: 77746
  derived and/or modified sequence opt1 from neuraminidase__InfluenzaA__ACV70187

SEQ ID NO: 78390 - RNA, 1410 nt, Artificial Sequence; identical to SEQ ID NO: 77746
  derived and/or modified sequence opt1 from neuraminidase__InfluenzaA__ACV70197

SEQ ID NO: 78391 - RNA, 1410 nt, Artificial Sequence; identical to SEQ ID NO: 77746
  derived and/or modified sequence opt1 from neuraminidase__InfluenzaA__ACV70207

SEQ ID NO: 78392 - RNA, 1410 nt, Artificial Sequence
  derived and/or modified sequence opt1 from neuraminidase__InfluenzaA__ACV70217
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcucccaccuggagugccgcaccuucuuccugacccagggcgcccuccugaacgacaagcacagcaacgggaccaucaaggaccggucccccuaccgcacgcugaugagcugccccaucggcgaggugccgucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggccccuccaacggccaggccagcuacaagaucuuccgcaucgagaaggggaagaucgugaaguccguggagaugaacgccccgaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccccggccgaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 78393 - RNA, 1410 nt, Artificial Sequence; identical to SEQ ID NO: 77746
  derived and/or modified sequence opt1 from neuraminidase__InfluenzaA__ACV70227

SEQ ID NO: 78394 - RNA, 1410 nt, Artificial Sequence; identical to SEQ ID NO: 77746
  derived and/or modified sequence opt1 from neuraminidase__InfluenzaA__ACV70237

SEQ ID NO: 78395 - RNA, 1410 nt, Artificial Sequence; identical to SEQ ID NO: 77746
  derived and/or modified sequence opt1 from neuraminidase__InfluenzaA__ACV70247

SEQ ID NO: 78396 - RNA, 1410 nt, Artificial Sequence; identical to SEQ ID NO: 77746
  derived and/or modified sequence opt1 from neuraminidase__InfluenzaA__ACV70257

SEQ ID NO: 78397 - RNA, 1410 nt, Artificial Sequence; identical to SEQ ID NO: 77746
  derived and/or modified sequence opt1 from neuraminidase__InfluenzaA__ACV70267

SEQ ID NO: 78398 - RNA, 1410 nt, Artificial Sequence; identical to SEQ ID NO: 77746
  derived and/or modified sequence opt1 from neuraminidase__InfluenzaA__ACV70277

SEQ ID NO: 78399 - RNA, 1410 nt, Artificial Sequence; identical to SEQ ID NO: 77746
  derived and/or modified sequence opt1 from neuraminidase__InfluenzaA__ACV70287

SEQ ID NO: 78400 - RNA, 1410 nt, Artificial Sequence; identical to SEQ ID NO: 77746
  derived and/or modified sequence opt1 from neuraminidase__InfluenzaA__ACV70297

SEQ ID NO: 78401 - RNA, 1410 nt, Artificial Sequence; identical to SEQ ID NO: 77746
  derived and/or modified sequence opt1 from neuraminidase__InfluenzaA__ACV70307

SEQ ID NO: 78402 - RNA, 1410 nt, Artificial Sequence; identical to SEQ ID NO: 77736
  derived and/or modified sequence opt1 from neuraminidase__InfluenzaA__ACV70317

SEQ ID NO: 78403 - RNA, 1410 nt, Artificial Sequence; identical to SEQ ID NO: 77746
  derived and/or modified sequence opt1 from neuraminidase__InfluenzaA__ACV70327

SEQ ID NO: 78404 - RNA, 1410 nt, Artificial Sequence; identical to SEQ ID NO: 77746
  derived and/or modified sequence opt1 from neuraminidase__InfluenzaA__ACV70337

SEQ ID NO: 78405 - RNA, 1410 nt, Artificial Sequence; identical to SEQ ID NO: 77746
  derived and/or modified sequence opt1 from neuraminidase__InfluenzaA__ACV70347

SEQ ID NO: 78406 - RNA, 1410 nt, Artificial Sequence; identical to SEQ ID NO: 77746
  derived and/or modified sequence opt1 from neuraminidase__InfluenzaA__ACV70357

SEQ ID NO: 78407 - RNA, 1410 nt, Artificial Sequence; identical to SEQ ID NO: 77746
  derived and/or modified sequence opt1 from neuraminidase__InfluenzaA__ACV70367

SEQ ID NO: 78408 - RNA, 1410 nt, Artificial Sequence; identical to SEQ ID NO: 77746
  derived and/or modified sequence opt1 from neuraminidase__InfluenzaA__ACV70377

SEQ ID NO: 78409 - RNA, 1410 nt, Artificial Sequence; identical to SEQ ID NO: 77746
  derived and/or modified sequence opt1 from neuraminidase__InfluenzaA__ACV70387

SEQ ID NO: 78410 - RNA, 1410 nt, Artificial Sequence; identical to SEQ ID NO: 77746
  derived and/or modified sequence opt1 from neuraminidase__InfluenzaA__ACV70397

SEQ ID NO: 78411 - RNA, 1410 nt, Artificial Sequence; identical to SEQ ID NO: 77746
  derived and/or modified sequence opt1 from neuraminidase__InfluenzaA__ACV70407

SEQ ID NO: 78412 - RNA, 1410 nt, Artificial Sequence; identical to SEQ ID NO: 77736
  derived and/or modified sequence opt1 from neuraminidase__InfluenzaA__ACV70417

SEQ ID NO: 78413 - RNA, 1410 nt, Artificial Sequence; identical to SEQ ID NO: 77746
  derived and/or modified sequence opt1 from neuraminidase__InfluenzaA__ACV70427

SEQ ID NO: 78414 - RNA, 1410 nt, Artificial Sequence; identical to SEQ ID NO: 77746
  derived and/or modified sequence opt1 from neuraminidase__InfluenzaA__ACV70437

SEQ ID NO: 78415 - RNA, 1410 nt, Artificial Sequence; identical to SEQ ID NO: 77746
  derived and/or modified sequence opt1 from neuraminidase__InfluenzaA__ACV70447

SEQ ID NO: 78416 - RNA, 1410 nt, Artificial Sequence; identical to SEQ ID NO: 77746
  derived and/or modified sequence opt1 from neuraminidase__InfluenzaA__ACV70457

SEQ ID NO: 78417 - RNA, 1410 nt, Artificial Sequence; identical to SEQ ID NO: 77746
  derived and/or modified sequence opt1 from neuraminidase__InfluenzaA__ACV70467

SEQ ID NO: 78418 - RNA, 1410 nt, Artificial Sequence; identical to SEQ ID NO: 77746
  derived and/or modified sequence opt1 from neuraminidase__InfluenzaA__ACV70477

SEQ ID NO: 78419 - RNA, 1410 nt, Artificial Sequence; identical to SEQ ID NO: 77746
  derived and/or modified sequence opt1 from neuraminidase__InfluenzaA__ACV70487

SEQ ID NO: 78420 - RNA, 1410 nt, Artificial Sequence; identical to SEQ ID NO: 77746
  derived and/or modified sequence opt1 from neuraminidase__InfluenzaA__ACV70497

SEQ ID NO: 78421 - RNA, 1410 nt, Artificial Sequence; identical to SEQ ID NO: 77746
  derived and/or modified sequence opt1 from neuraminidase__InfluenzaA__ACV70507

SEQ ID NO: 78422 - RNA, 1410 nt, Artificial Sequence; identical to SEQ ID NO: 77746
  derived and/or modified sequence opt1 from neuraminidase__InfluenzaA__ACV70517

SEQ ID NO: 78423 - RNA, 1410 nt, Artificial Sequence; identical to SEQ ID NO: 77746
  derived and/or modified sequence opt1 from neuraminidase__InfluenzaA__ACV70527

SEQ ID NO: 78424 - RNA, 1410 nt, Artificial Sequence; identical to SEQ ID NO: 77746
  derived and/or modified sequence opt1 from neuraminidase__InfluenzaA__ACV70547

SEQ ID NO: 78425 - RNA, 1410 nt, Artificial Sequence; identical to SEQ ID NO: 77746
  derived and/or modified sequence opt1 from neuraminidase__InfluenzaA__ACV70557

SEQ ID NO: 78426 - RNA, 1410 nt, Artificial Sequence; identical to SEQ ID NO: 77746
  derived and/or modified sequence opt1 from neuraminidase__InfluenzaA__ACV70567

SEQ ID NO: 78427 - RNA, 1410 nt, Artificial Sequence; identical to SEQ ID NO: 77746
  derived and/or modified sequence opt1 from neuraminidase__InfluenzaA__ACV70577

SEQ ID NO: 78428 - RNA, 1410 nt, Artificial Sequence; identical to SEQ ID NO: 77746
  derived and/or modified sequence opt1 from neuraminidase__InfluenzaA__ACV70587

SEQ ID NO: 78429 - RNA, 1410 nt, Artificial Sequence; identical to SEQ ID NO: 77736
  derived and/or modified sequence opt1 from neuraminidase__InfluenzaA__ACV70597

SEQ ID NO: 78430 - RNA, 1410 nt, Artificial Sequence; identical to SEQ ID NO: 77746
  derived and/or modified sequence opt1 from neuraminidase__InfluenzaA__ACV70607

SEQ ID NO: 78431 - RNA, 1410 nt, Artificial Sequence; identical to SEQ ID NO: 78329
  derived and/or modified sequence opt1 from neuraminidase__InfluenzaA__ACV70617

SEQ ID NO: 78432 - RNA, 1410 nt, Artificial Sequence; identical to SEQ ID NO: 77746
  derived and/or modified sequence opt1 from neuraminidase__InfluenzaA__ACV70647

SEQ ID NO: 78433 - RNA, 1410 nt, Artificial Sequence; identical to SEQ ID NO: 77746
  derived and/or modified sequence opt1 from neuraminidase__InfluenzaA__ACV70657

SEQ ID NO: 78434 - RNA, 1410 nt, Artificial Sequence; identical to SEQ ID NO: 77746
  derived and/or modified sequence opt1 from neuraminidase__InfluenzaA__ACV70667

SEQ ID NO: 78435 - RNA, 1410 nt, Artificial Sequence; identical to SEQ ID NO: 77746
  derived and/or modified sequence opt1 from neuraminidase__InfluenzaA__ACV70677

SEQ ID NO: 78436 - RNA, 1410 nt, Artificial Sequence; identical to SEQ ID NO: 77746
  derived and/or modified sequence opt1 from neuraminidase__InfluenzaA__ACV70687

SEQ ID NO: 78437 - RNA, 1410 nt, Artificial Sequence; identical to SEQ ID NO: 77746
  derived and/or modified sequence opt1 from neuraminidase__InfluenzaA__ACV70697

SEQ ID NO: 78438 - RNA, 1410 nt, Artificial Sequence; identical to SEQ ID NO: 77746
  derived and/or modified sequence opt1 from neuraminidase__InfluenzaA__ACV70707

SEQ ID NO: 78439 - RNA, 1410 nt, Artificial Sequence; identical to SEQ ID NO: 77746
  derived and/or modified sequence opt1 from neuraminidase__InfluenzaA__ACV70717

SEQ ID NO: 78440 - RNA, 1410 nt, Artificial Sequence; identical to SEQ ID NO: 77746
  derived and/or modified sequence opt1 from neuraminidase__InfluenzaA__ACV70727

SEQ ID NO: 78441 - RNA, 1410 nt, Artificial Sequence; identical to SEQ ID NO: 77746
  derived and/or modified sequence opt1 from neuraminidase__InfluenzaA__ACV70737

SEQ ID NO: 78442 - RNA, 1410 nt, Artificial Sequence; identical to SEQ ID NO: 77746
  derived and/or modified sequence opt1 from neuraminidase__InfluenzaA__ACV70757

SEQ ID NO: 78443 - RNA, 1410 nt, Artificial Sequence; identical to SEQ ID NO: 77746
  derived and/or modified sequence opt1 from neuraminidase__InfluenzaA__ACV70767

SEQ ID NO: 78444 - RNA, 1410 nt, Artificial Sequence; identical to SEQ ID NO: 77746
  derived and/or modified sequence opt1 from neuraminidase__InfluenzaA__ACV70777

SEQ ID NO: 78445 - RNA, 1410 nt, Artificial Sequence; identical to SEQ ID NO: 77746
  derived and/or modified sequence opt1 from neuraminidase__InfluenzaA__ACV70787

SEQ ID NO: 78446 - RNA, 1410 nt, Artificial Sequence; identical to SEQ ID NO: 77746
  derived and/or modified sequence opt1 from neuraminidase__InfluenzaA__ACV70797

SEQ ID NO: 78447 - RNA, 1410 nt, Artificial Sequence; identical to SEQ ID NO: 77746
  derived and/or modified sequence opt1 from neuraminidase__InfluenzaA__ACV70807

SEQ ID NO: 78448 - RNA, 1410 nt, Artificial Sequence; identical to SEQ ID NO: 77746
  derived and/or modified sequence opt1 from neuraminidase__InfluenzaA__ACV70817

SEQ ID NO: 78449 - RNA, 1410 nt, Artificial Sequence; identical to SEQ ID NO: 77736
  derived and/or modified sequence opt1 from neuraminidase__InfluenzaA__ACV70827

SEQ ID NO: 78450 - RNA, 1410 nt, Artificial Sequence; identical to SEQ ID NO: 77746
  derived and/or modified sequence opt1 from neuraminidase__InfluenzaA__ACV70837

SEQ ID NO: 78451 - RNA, 1410 nt, Artificial Sequence
  derived and/or modified sequence opt1 from neuraminidase__InfluenzaA__ACV70847
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaugagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78452 - RNA, 1410 nt, Artificial Sequence; identical to SEQ ID NO: 77746
  derived and/or modified sequence opt1 from neuraminidase__InfluenzaA__ACV70867

SEQ ID NO: 78453 - RNA, 1410 nt, Artificial Sequence; identical to SEQ ID NO: 77746
  derived and/or modified sequence opt1 from neuraminidase__InfluenzaA__ACV70877

SEQ ID NO: 78454 - RNA, 1410 nt, Artificial Sequence
  derived and/or modified sequence opt1 from neuraminidase__InfluenzaA__ACV70887
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78455 - RNA, 1410 nt, Artificial Sequence; identical to SEQ ID NO: 77746
  derived and/or modified sequence opt1 from neuraminidase__InfluenzaA__ACV70897

SEQ ID NO: 78456 - RNA, 1410 nt, Artificial Sequence; identical to SEQ ID NO: 77746
  derived and/or modified sequence opt1 from neuraminidase__InfluenzaA__ACV70907

SEQ ID NO: 78457 - RNA, 1410 nt, Artificial Sequence; identical to SEQ ID NO: 77746
  derived and/or modified sequence opt1 from neuraminidase__InfluenzaA__ACV70917

SEQ ID NO: 78458 - RNA, 1410 nt, Artificial Sequence; identical to SEQ ID NO: 77736
  derived and/or modified sequence opt1 from neuraminidase__InfluenzaA__ACV70927

SEQ ID NO: 78459 - RNA, 1410 nt, Artificial Sequence; identical to SEQ ID NO: 77746
  derived and/or modified sequence opt1 from neuraminidase__InfluenzaA__ACV70937

SEQ ID NO: 78460 - RNA, 1410 nt, Artificial Sequence; identical to SEQ ID NO: 77746
  derived and/or modified sequence opt1 from neuraminidase__InfluenzaA__ACV70947

SEQ ID NO: 78461 - RNA, 1410 nt, Artificial Sequence; identical to SEQ ID NO: 77746
  derived and/or modified sequence opt1 from neuraminidase__InfluenzaA__ACV70957

SEQ ID NO: 78462 - RNA, 1410 nt, Artificial Sequence; identical to SEQ ID NO: 77746
  derived and/or modified sequence opt1 from neuraminidase__InfluenzaA__ACV70967

SEQ ID NO: 78463 - RNA, 1410 nt, Artificial Sequence; identical to SEQ ID NO: 77746
  derived and/or modified sequence opt1 from neuraminidase__InfluenzaA__ACV70977

SEQ ID NO: 78464 - RNA, 1410 nt, Artificial Sequence; identical to SEQ ID NO: 77746
  derived and/or modified sequence opt1 from neuraminidase__InfluenzaA__ACV70987

SEQ ID NO: 78465 - RNA, 1410 nt, Artificial Sequence; identical to SEQ ID NO: 77746
  derived and/or modified sequence opt1 from neuraminidase__InfluenzaA__ACV71007

SEQ ID NO: 78466 - RNA, 1410 nt, Artificial Sequence; identical to SEQ ID NO: 77607
  derived and/or modified sequence opt1 from neuraminidase__InfluenzaA__ACV82218

SEQ ID NO: 78467 - RNA, 1410 nt, Artificial Sequence; identical to SEQ ID NO: 77607
  derived and/or modified sequence opt1 from neuraminidase__InfluenzaA__ACV82219

SEQ ID NO: 78468 - RNA, 1410 nt, Artificial Sequence
  derived and/or modified sequence opt1 from neuraminidase__InfluenzaA__ACV82220
augaaccccaaccagaagaucaucaccaucggcagcgugucccugaccaucagcacgaucugcuucuucaugcagcucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccuacagcugccacgacgggaaggccuggcugcacgugugcaucaccggcgacgacaagaacgcgaccgccuccuucaucuacaacgggcggcugguggacagcguggucuccuggagcaaggagauccuccgcacccaggaguccgagugcgugugcaucaacggcacgugcaccguggucaugaccgacgggagcgccuccggcaaggccgacaccaagauccuguucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccucgugggcgacacgccccggaagaacgacagcuccagcuccagccacugccuggaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggagaagaccgaggugcuguggaccagcaacuccaucgucguguucugcggcaccagcgggacguacggcaccggguccuggccggacggcgccgacaucaaccucaugcccaucuga

SEQ ID NO: 78469 - RNA, 1413 nt, Artificial Sequence
  derived and/or modified sequence opt1 from neuraminidase__InfluenzaA__ACV82221
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 78470 - RNA, 1410 nt, Artificial Sequence; identical to SEQ ID NO: 77746
  derived and/or modified sequence opt1 from neuraminidase__InfluenzaA__ACV88402

SEQ ID NO: 78471 - RNA, 1410 nt, Artificial Sequence; identical to SEQ ID NO: 77746
  derived and/or modified sequence opt1 from neuraminidase__InfluenzaA__ACV88412

SEQ ID NO: 78472 - RNA, 1410 nt, Artificial Sequence; identical to SEQ ID NO: 77736
  derived and/or modified sequence opt1 from neuraminidase__InfluenzaA__ACV88422

SEQ ID NO: 78473 - RNA, 1365 nt, Artificial Sequence
  derived and/or modified sequence opt1 from neuraminidase__InfluenzaA__ACV89505
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuucgagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgggacaacuggcacggcagcaaccgccccuggguguccuucgaccagaaccucgacuaccagaucggguacaucugcagcggcgucuucggcgacaacccccggccggaggacgggaccggcuccugcgggcccguguacguggacggcgccaacggggucaagggcuucagcuaccgcuacggcaacgggguguggaucggccggaccaagucccacagcucccgccacggguucgagaugaucugggaccccaacggcuggaccgagacggacagcaaguucagcgugcggcaggacgucguggccaugaccgacugguccggguacagcggcuccuucgugcagcaccccgagcugaccggccuggacugcaugcgcccgugcuucugggucgagcucauccgggggcgccccaaggagggcaccaucuggacgagcgccuccagcaucuccuucugcggggugaacagcgacaccgucgacugguccuggcccgacggcgccgagcugcccuucagcaucgacaaguga

SEQ ID NO: 78474 - RNA, 1410 nt, Artificial Sequence; identical to SEQ ID NO: 77746
  derived and/or modified sequence opt1 from neuraminidase__InfluenzaA__ACV91673

SEQ ID NO: 78475 - RNA, 1410 nt, Artificial Sequence; identical to SEQ ID NO: 77746
  derived and/or modified sequence opt1 from neuraminidase__InfluenzaA__ACV91681

SEQ ID NO: 78476 - RNA, 1410 nt, Artificial Sequence
  derived and/or modified sequence opt1 from neuraminidase__InfluenzaA__ACX31593
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugcugcucugcgagcccgccaucaucgagcgcaacaucacggagaucguguaccugaccaacaccaccaucgagaaggagaucugccccaagcuggcggaguaccggaacuggagcaagccgcagugcgacaucacgggguucgcccccuucuccaaggacaacagcauccgccucuccgccggcggggacaucugggucacccgggagcccuacgugagcugcgaccccgacaagugcuaccaguucgcccugggccaggggaccacccugaacaacgugcacuccaacaacacgguccgcgaccggaccccguaccgcacccuccugaugaacgagcugggcgugcccuuccaccucggcaccaagcaggucugcaucgccuggagcuccagcuccugccacgacgggaaggcguggcugcacgugugcaucacgggcgacgacaagaacgccaccgccagcuucaucuacaacgggcggcugguggacuccguggucagcugguccaaggagauccuccgcacccaggagagcgagugcgugugcaucaacgggaccugcacgguggucaugaccgacggguccgccagcggcaaggcggacaccaagauccuguucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcuccagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcuguggaccuccaacagcaucgucguguucugcggcaccuccgggaccuacggcacggggagcuggccggacggcgccgacaucaaccucaugcccaucuga

SEQ ID NO: 78477 - RNA, 1410 nt, Artificial Sequence; identical to SEQ ID NO: 77746
  derived and/or modified sequence opt1 from neuraminidase__InfluenzaA__ACX31901

SEQ ID NO: 78478 - RNA, 1410 nt, Artificial Sequence; identical to SEQ ID NO: 77746
  derived and/or modified sequence opt1 from neuraminidase__InfluenzaA__ACX31902

SEQ ID NO: 78479 - RNA, 1410 nt, Artificial Sequence; identical to SEQ ID NO: 77746
  derived and/or modified sequence opt1 from neuraminidase__InfluenzaA__ACX31905

SEQ ID NO: 78480 - RNA, 1410 nt, Artificial Sequence; identical to SEQ ID NO: 77746
  derived and/or modified sequence opt1 from neuraminidase__InfluenzaA__ACX31906

SEQ ID NO: 78481 - RNA, 1410 nt, Artificial Sequence; identical to SEQ ID NO: 77746
  derived and/or modified sequence opt1 from neuraminidase__InfluenzaA__ACX31907

SEQ ID NO: 78482 - RNA, 1410 nt, Artificial Sequence; identical to SEQ ID NO: 77746
  derived and/or modified sequence opt1 from neuraminidase__InfluenzaA__ACX31908

SEQ ID NO: 78483 - RNA, 1410 nt, Artificial Sequence; identical to SEQ ID NO: 77901
  derived and/or modified sequence opt1 from neuraminidase__InfluenzaA__ACX31909

SEQ ID NO: 78484 - RNA, 1410 nt, Artificial Sequence; identical to SEQ ID NO: 77746
  derived and/or modified sequence opt1 from neuraminidase__InfluenzaA__ACX31911

SEQ ID NO: 78485 - RNA, 1410 nt, Artificial Sequence; identical to SEQ ID NO: 77746
  derived and/or modified sequence opt1 from neuraminidase__InfluenzaA__ACX31912

SEQ ID NO: 78486 - RNA, 1410 nt, Artificial Sequence; identical to SEQ ID NO: 77746
  derived and/or modified sequence opt1 from neuraminidase__InfluenzaA__ACX31913

SEQ ID NO: 78487 - RNA, 1410 nt, Artificial Sequence; identical to SEQ ID NO: 77746
  derived and/or modified sequence opt1 from neuraminidase__InfluenzaA__ACX31914

SEQ ID NO: 78488 - RNA, 1410 nt, Artificial Sequence; identical to SEQ ID NO: 77746
  derived and/or modified sequence opt1 from neuraminidase__InfluenzaA__ACX31915

SEQ ID NO: 78489 - RNA, 1410 nt, Artificial Sequence; identical to SEQ ID NO: 77746
  derived and/or modified sequence opt1 from neuraminidase__InfluenzaA__ACX31916

SEQ ID NO: 78490 - RNA, 1410 nt, Artificial Sequence
  derived and/or modified sequence opt1 from neuraminidase__InfluenzaA__ACX31917
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucacggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 78491 - RNA, 1410 nt, Artificial Sequence; identical to SEQ ID NO: 77746
  derived and/or modified sequence opt1 from neuraminidase__InfluenzaA__ACX31918

SEQ ID NO: 78492 - RNA, 1410 nt, Artificial Sequence; identical to SEQ ID NO: 77746
  derived and/or modified sequence opt1 from neuraminidase__InfluenzaA__ACX31919

SEQ ID NO: 78493 - RNA, 1410 nt, Artificial Sequence; identical to SEQ ID NO: 77746
  derived and/or modified sequence opt1 from neuraminidase__InfluenzaA__ACX31920

SEQ ID NO: 78494 - RNA, 1410 nt, Artificial Sequence; identical to SEQ ID NO: 78100
  derived and/or modified sequence opt1 from neuraminidase__InfluenzaA__ACX31922

SEQ ID NO: 78495 - RNA, 1410 nt, Artificial Sequence; identical to SEQ ID NO: 77746
  derived and/or modified sequence opt1 from neuraminidase__InfluenzaA__ACX31923

SEQ ID NO: 78496 - RNA, 1410 nt, Artificial Sequence; identical to SEQ ID NO: 77736
  derived and/or modified sequence opt1 from neuraminidase__InfluenzaA__ACX31924

SEQ ID NO: 78497 - RNA, 1410 nt, Artificial Sequence
  derived and/or modified sequence opt1 from neuraminidase__InfluenzaA__ACX31925
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucaucaucgacaaguga

SEQ ID NO: 78498 - RNA, 1410 nt, Artificial Sequence; identical to SEQ ID NO: 77746
  derived and/or modified sequence opt1 from neuraminidase__InfluenzaA__ACX31926

SEQ ID NO: 78499 - RNA, 1410 nt, Artificial Sequence; identical to SEQ ID NO: 77746
  derived and/or modified sequence opt1 from neuraminidase__InfluenzaA__ACX31927

SEQ ID NO: 78500 - RNA, 1410 nt, Artificial Sequence
  derived and/or modified sequence opt1 from neuraminidase__InfluenzaA__ACX31928
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggagaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacggggacaccgucggcuggagcuggcccgacggcgccgagcugccguucacgaucgacaaguga

SEQ ID NO: 78501 - RNA, 1410 nt, Artificial Sequence; identical to SEQ ID NO: 77776
  derived and/or modified sequence opt1 from neuraminidase__InfluenzaA__ACX31929

SEQ ID NO: 78502 - RNA, 1410 nt, Artificial Sequence; identical to SEQ ID NO: 78100
  derived and/or modified sequence opt1 from neuraminidase__InfluenzaA__ACX31930

SEQ ID NO: 78503 - RNA, 1410 nt, Artificial Sequence; identical to SEQ ID NO: 77746
  derived and/or modified sequence opt1 from neuraminidase__InfluenzaA__ACX31931

SEQ ID NO: 78504 - RNA, 1410 nt, Artificial Sequence; identical to SEQ ID NO: 77746
  derived and/or modified sequence opt1 from neuraminidase__InfluenzaA__ACX31932

SEQ ID NO: 78505 - RNA, 1410 nt, Artificial Sequence; identical to SEQ ID NO: 77746
  derived and/or modified sequence opt1 from neuraminidase__InfluenzaA__ACX35250

SEQ ID NO: 78506 - RNA, 1410 nt, Artificial Sequence; identical to SEQ ID NO: 77746
  derived and/or modified sequence opt1 from neuraminidase__InfluenzaA__ACX35260

SEQ ID NO: 78507 - RNA, 1410 nt, Artificial Sequence; identical to SEQ ID NO: 77746
  derived and/or modified sequence opt1 from neuraminidase__InfluenzaA__ACX35270

SEQ ID NO: 78508 - RNA, 1410 nt, Artificial Sequence
  derived and/or modified sequence opt1 from neuraminidase__InfluenzaA__ACX35280
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggacaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78509 - RNA, 1410 nt, Artificial Sequence; identical to SEQ ID NO: 77746
  derived and/or modified sequence opt1 from neuraminidase__InfluenzaA__ACX35290

SEQ ID NO: 78510 - RNA, 1410 nt, Artificial Sequence; identical to SEQ ID NO: 77746
  derived and/or modified sequence opt1 from neuraminidase__InfluenzaA__ACX35300

SEQ ID NO: 78511 - RNA, 1410 nt, Artificial Sequence
  derived and/or modified sequence opt1 from neuraminidase__InfluenzaA__ACX35310
augaaccccaaccagaagaucaucaccaucggcagcgugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 78512 - RNA, 1410 nt, Artificial Sequence; identical to SEQ ID NO: 77746
  derived and/or modified sequence opt1 from neuraminidase__InfluenzaA__ACX35320

SEQ ID NO: 78513 - RNA, 1410 nt, Artificial Sequence
  derived and/or modified sequence opt1 from neuraminidase__InfluenzaA__ACX35330
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78514 - RNA, 1410 nt, Artificial Sequence; identical to SEQ ID NO: 77746
  derived and/or modified sequence opt1 from neuraminidase__InfluenzaA__ACX48479

SEQ ID NO: 78515 - RNA, 1410 nt, Artificial Sequence; identical to SEQ ID NO: 77746
  derived and/or modified sequence opt1 from neuraminidase__InfluenzaA__ACX48481

SEQ ID NO: 78516 - RNA, 1410 nt, Artificial Sequence; identical to SEQ ID NO: 77746
  derived and/or modified sequence opt1 from neuraminidase__InfluenzaA__ACX55836

SEQ ID NO: 78517 - RNA, 1410 nt, Artificial Sequence
  derived and/or modified sequence opt1 from neuraminidase__InfluenzaA__ACX56269
augaaccccaagcagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78518 - RNA, 1410 nt, Artificial Sequence
  derived and/or modified sequence opt1 from neuraminidase__InfluenzaA__ACX56270
augaaccccaagcagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacuccgucagcugguccuggcccgacggggccgagcugccguucaccaucgacaaguga

SEQ ID NO: 78519 - RNA, 1410 nt, Artificial Sequence
  derived and/or modified sequence opt1 from neuraminidase__InfluenzaA__ACX56271
augaaccccaagcagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucggguccgugaagcucgccggcaacagcucccugugcccggugagcggcugggccaucuacuccaaggacaacagcauccgcaucggguccaagggcgacgucuucgugauccgggagcccuucaucagcugcagcccccuggagugccgcaccuucuuccucacccagggggcccugcugaacgacaagcacuccaacggcaccaucaaggaccggucccccuaccgcacgcucaugagcugcccgaucggggaggugcccucccccuacaacagccgguucgagagcgucgccugguccgcgagcgccugccacgacggcaucaacuggcugaccaucggcaucuccgggcccgacaacggcgccguggccgugcugaaguacaacgggaucaucaccgacaccaucaagagcuggcgcaacaacauccuccggacgcaggaguccgagugcgcgugcgucaacggcagcugcuucaccgugaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccuggaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacagcggcuccuucgugcagcacccggagcugacgggccucgacugcauccgccccugcuucuggguggagcugauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 78520 - RNA, 1410 nt, Artificial Sequence; identical to SEQ ID NO: 77746
  derived and/or modified sequence opt1 from neuraminidase__InfluenzaA__ACX83579

SEQ ID NO: 78521 - RNA, 1410 nt, Artificial Sequence; identical to SEQ ID NO: 77746
  derived and/or modified sequence opt1 from neuraminidase__InfluenzaA__ACX85425

SEQ ID NO: 78522 - RNA, 1410 nt, Artificial Sequence; identical to SEQ ID NO: 77746
  derived and/or modified sequence opt1 from neuraminidase__InfluenzaA__ACX85426

SEQ ID NO: 78523 - RNA, 1410 nt, Artificial Sequence
  derived and/or modified sequence opt1 from neuraminidase__InfluenzaA__ACY02998
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccggcgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 78524 - RNA, 1410 nt, Artificial Sequence; identical to SEQ ID NO: 77746
  derived and/or modified sequence opt1 from neuraminidase__InfluenzaA__ACY03005

SEQ ID NO: 78525 - RNA, 1410 nt, Artificial Sequence; identical to SEQ ID NO: 77746
  derived and/or modified sequence opt1 from neuraminidase__InfluenzaA__ACY03008

SEQ ID NO: 78526 - RNA, 1410 nt, Artificial Sequence; identical to SEQ ID NO: 77746
  derived and/or modified sequence opt1 from neuraminidase__InfluenzaA__ACY03011

SEQ ID NO: 78527 - RNA, 1410 nt, Artificial Sequence; identical to SEQ ID NO: 77746
  derived and/or modified sequence opt1 from neuraminidase__InfluenzaA__ACY03012

SEQ ID NO: 78528 - RNA, 1410 nt, Artificial Sequence; identical to SEQ ID NO: 77746
  derived and/or modified sequence opt1 from neuraminidase__InfluenzaA__ACY03016

SEQ ID NO: 78529 - RNA, 1410 nt, Artificial Sequence; identical to SEQ ID NO: 77746
  derived and/or modified sequence opt1 from neuraminidase__InfluenzaA__ACY26194

SEQ ID NO: 78530 - RNA, 1410 nt, Artificial Sequence; identical to SEQ ID NO: 77746
  derived and/or modified sequence opt1 from neuraminidase__InfluenzaA__ACY26204

SEQ ID NO: 78531 - RNA, 1410 nt, Artificial Sequence; identical to SEQ ID NO: 77746
  derived and/or modified sequence opt1 from neuraminidase__InfluenzaA__ACY30123

SEQ ID NO: 78532 - RNA, 1410 nt, Artificial Sequence; identical to SEQ ID NO: 77746
  derived and/or modified sequence opt1 from neuraminidase__InfluenzaA__ACY30124

SEQ ID NO: 78533 - RNA, 1410 nt, Artificial Sequence; identical to SEQ ID NO: 77746
  derived and/or modified sequence opt1 from neuraminidase__InfluenzaA__ACY30125

SEQ ID NO: 78534 - RNA, 1410 nt, Artificial Sequence; identical to SEQ ID NO: 77746
  derived and/or modified sequence opt1 from neuraminidase__InfluenzaA__ACY30127

SEQ ID NO: 78535 - RNA, 1410 nt, Artificial Sequence; identical to SEQ ID NO: 77746
  derived and/or modified sequence opt1 from neuraminidase__InfluenzaA__ACY30128

SEQ ID NO: 78536 - RNA, 1410 nt, Artificial Sequence; identical to SEQ ID NO: 77746
  derived and/or modified sequence opt1 from neuraminidase__InfluenzaA__ACY46105

SEQ ID NO: 78537 - RNA, 1410 nt, Artificial Sequence; identical to SEQ ID NO: 77746
  derived and/or modified sequence opt1 from neuraminidase__InfluenzaA__ACY46165

SEQ ID NO: 78538 - RNA, 1410 nt, Artificial Sequence; identical to SEQ ID NO: 77746
  derived and/or modified sequence opt1 from neuraminidase__InfluenzaA__ACY46175

SEQ ID NO: 78539 - RNA, 1410 nt, Artificial Sequence; identical to SEQ ID NO: 77746
  derived and/or modified sequence opt1 from neuraminidase__InfluenzaA__ACY46345

SEQ ID NO: 78540 - RNA, 1410 nt, Artificial Sequence; identical to SEQ ID NO: 77746
  derived and/or modified sequence opt1 from neuraminidase__InfluenzaA__ACY46385

SEQ ID NO: 78541 - RNA, 1410 nt, Artificial Sequence; identical to SEQ ID NO: 77746
  derived and/or modified sequence opt1 from neuraminidase__InfluenzaA__ACY46485

SEQ ID NO: 78542 - RNA, 1410 nt, Artificial Sequence; identical to SEQ ID NO: 77776
  derived and/or modified sequence opt1 from neuraminidase__InfluenzaA__ACY77536

SEQ ID NO: 78543 - RNA, 1410 nt, Artificial Sequence; identical to SEQ ID NO: 77736
  derived and/or modified sequence opt1 from neuraminidase__InfluenzaA__ACY77546

SEQ ID NO: 78544 - RNA, 1410 nt, Artificial Sequence; identical to SEQ ID NO: 77776
  derived and/or modified sequence opt1 from neuraminidase__InfluenzaA__ACY77565

SEQ ID NO: 78545 - RNA, 1410 nt, Artificial Sequence
  derived and/or modified sequence opt1 from neuraminidase__InfluenzaA__ACY77575
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccagcgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78546 - RNA, 1410 nt, Artificial Sequence; identical to SEQ ID NO: 77746
  derived and/or modified sequence opt1 from neuraminidase__InfluenzaA__ACY77585

SEQ ID NO: 78547 - RNA, 1410 nt, Artificial Sequence; identical to SEQ ID NO: 77776
  derived and/or modified sequence opt1 from neuraminidase__InfluenzaA__ACY77595

SEQ ID NO: 78548 - RNA, 1410 nt, Artificial Sequence; identical to SEQ ID NO: 77776
  derived and/or modified sequence opt1 from neuraminidase__InfluenzaA__ACY77605

SEQ ID NO: 78549 - RNA, 1410 nt, Artificial Sequence; identical to SEQ ID NO: 77746
  derived and/or modified sequence opt1 from neuraminidase__InfluenzaA__ACY77625

SEQ ID NO: 78550 - RNA, 1410 nt, Artificial Sequence
  derived and/or modified sequence opt1 from neuraminidase__InfluenzaA__ACY77655
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccuucaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 78551 - RNA, 1410 nt, Artificial Sequence; identical to SEQ ID NO: 77746
  derived and/or modified sequence opt1 from neuraminidase__InfluenzaA__ACY77665

SEQ ID NO: 78552 - RNA, 1410 nt, Artificial Sequence; identical to SEQ ID NO: 77746
  derived and/or modified sequence opt1 from neuraminidase__InfluenzaA__ACY77675

SEQ ID NO: 78553 - RNA, 1410 nt, Artificial Sequence; identical to SEQ ID NO: 77736
  derived and/or modified sequence opt1 from neuraminidase__InfluenzaA__ACY77685

SEQ ID NO: 78554 - RNA, 1410 nt, Artificial Sequence; identical to SEQ ID NO: 77736
  derived and/or modified sequence opt1 from neuraminidase__InfluenzaA__ACY77695

SEQ ID NO: 78555 - RNA, 1410 nt, Artificial Sequence; identical to SEQ ID NO: 77736
  derived and/or modified sequence opt1 from neuraminidase__InfluenzaA__ACY77705

SEQ ID NO: 78556 - RNA, 1410 nt, Artificial Sequence; identical to SEQ ID NO: 77736
  derived and/or modified sequence opt1 from neuraminidase__InfluenzaA__ACY77725

SEQ ID NO: 78557 - RNA, 1410 nt, Artificial Sequence; identical to SEQ ID NO: 77736
  derived and/or modified sequence opt1 from neuraminidase__InfluenzaA__ACY77735

SEQ ID NO: 78558 - RNA, 1410 nt, Artificial Sequence; identical to SEQ ID NO: 77746
  derived and/or modified sequence opt1 from neuraminidase__InfluenzaA__ACY77745

SEQ ID NO: 78559 - RNA, 1410 nt, Artificial Sequence; identical to SEQ ID NO: 77746
  derived and/or modified sequence opt1 from neuraminidase__InfluenzaA__ACY77755

SEQ ID NO: 78560 - RNA, 1410 nt, Artificial Sequence; identical to SEQ ID NO: 77746
  derived and/or modified sequence opt1 from neuraminidase__InfluenzaA__ACY77775

SEQ ID NO: 78561 - RNA, 1410 nt, Artificial Sequence; identical to SEQ ID NO: 77746
  derived and/or modified sequence opt1 from neuraminidase__InfluenzaA__ACY77785

SEQ ID NO: 78562 - RNA, 1410 nt, Artificial Sequence; identical to SEQ ID NO: 77746
  derived and/or modified sequence opt1 from neuraminidase__InfluenzaA__ACY77795

SEQ ID NO: 78563 - RNA, 1410 nt, Artificial Sequence
  derived and/or modified sequence opt1 from neuraminidase__InfluenzaA__ACY77825
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucaacagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaaguga

SEQ ID NO: 78564 - RNA, 1410 nt, Artificial Sequence; identical to SEQ ID NO: 78563
  derived and/or modified sequence opt1 from neuraminidase__InfluenzaA__ACY77835

SEQ ID NO: 78565 - RNA, 1410 nt, Artificial Sequence; identical to SEQ ID NO: 77776
  derived and/or modified sequence opt1 from neuraminidase__InfluenzaA__ACY77845

SEQ ID NO: 78566 - RNA, 1410 nt, Artificial Sequence; identical to SEQ ID NO: 77746
  derived and/or modified sequence opt1 from neuraminidase__InfluenzaA__ACY77865

SEQ ID NO: 78567 - RNA, 1410 nt, Artificial Sequence
  derived and/or modified sequence opt1 from neuraminidase__InfluenzaA__ACY77870
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78568 - RNA, 1410 nt, Artificial Sequence; identical to SEQ ID NO: 77746
  derived and/or modified sequence opt1 from neuraminidase__InfluenzaA__ACY77877

SEQ ID NO: 78569 - RNA, 1410 nt, Artificial Sequence; identical to SEQ ID NO: 77746
  derived and/or modified sequence opt1 from neuraminidase__InfluenzaA__ACY77887

SEQ ID NO: 78570 - RNA, 1410 nt, Artificial Sequence; identical to SEQ ID NO: 77746
  derived and/or modified sequence opt1 from neuraminidase__InfluenzaA__ACY77907

SEQ ID NO: 78571 - RNA, 1410 nt, Artificial Sequence; identical to SEQ ID NO: 77776
  derived and/or modified sequence opt1 from neuraminidase__InfluenzaA__ACY77917

SEQ ID NO: 78572 - RNA, 1410 nt, Artificial Sequence
  derived and/or modified sequence opt1 from neuraminidase__InfluenzaA__ACY77927
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccaacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78573 - RNA, 1410 nt, Artificial Sequence; identical to SEQ ID NO: 77746
  derived and/or modified sequence opt1 from neuraminidase__InfluenzaA__ACY77937

SEQ ID NO: 78574 - RNA, 1410 nt, Artificial Sequence; identical to SEQ ID NO: 77746
  derived and/or modified sequence opt1 from neuraminidase__InfluenzaA__ACY77947

SEQ ID NO: 78575 - RNA, 1410 nt, Artificial Sequence; identical to SEQ ID NO: 77746
  derived and/or modified sequence opt1 from neuraminidase__InfluenzaA__ACY77967

SEQ ID NO: 78576 - RNA, 1410 nt, Artificial Sequence; identical to SEQ ID NO: 77736
  derived and/or modified sequence opt1 from neuraminidase__InfluenzaA__ACY77977

SEQ ID NO: 78577 - RNA, 1410 nt, Artificial Sequence; identical to SEQ ID NO: 77746
  derived and/or modified sequence opt1 from neuraminidase__InfluenzaA__ACY77987

SEQ ID NO: 78578 - RNA, 1410 nt, Artificial Sequence
  derived and/or modified sequence opt1 from neuraminidase__InfluenzaA__ACY77997
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugacccuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 78579 - RNA, 1410 nt, Artificial Sequence; identical to SEQ ID NO: 77746
  derived and/or modified sequence opt1 from neuraminidase__InfluenzaA__ACY78017

SEQ ID NO: 78580 - RNA, 1410 nt, Artificial Sequence
  derived and/or modified sequence opt1 from neuraminidase__InfluenzaA__ACZ01955
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgggaacggcgccguggccguccugaaguacaacgggaucaucaccgacaccaucaagagcuggcgcaacaacauccugcggacgcaggaguccgagugcgcgugcgugaacggcagcugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 78581 - RNA, 1410 nt, Artificial Sequence; identical to SEQ ID NO: 77746
  derived and/or modified sequence opt1 from neuraminidase__InfluenzaA__ACZ05053

SEQ ID NO: 78582 - RNA, 1410 nt, Artificial Sequence; identical to SEQ ID NO: 77736
  derived and/or modified sequence opt1 from neuraminidase__InfluenzaA__ACZ05064

SEQ ID NO: 78583 - RNA, 1410 nt, Artificial Sequence; identical to SEQ ID NO: 77746
  derived and/or modified sequence opt1 from neuraminidase__InfluenzaA__ACZ05074

SEQ ID NO: 78584 - RNA, 1410 nt, Artificial Sequence; identical to SEQ ID NO: 77746
  derived and/or modified sequence opt1 from neuraminidase__InfluenzaA__ACZ05084

SEQ ID NO: 78585 - RNA, 1410 nt, Artificial Sequence; identical to SEQ ID NO: 77746
  derived and/or modified sequence opt1 from neuraminidase__InfluenzaA__ACZ05094

SEQ ID NO: 78586 - RNA, 1410 nt, Artificial Sequence; identical to SEQ ID NO: 77746
  derived and/or modified sequence opt1 from neuraminidase__InfluenzaA__ACZ05104

SEQ ID NO: 78587 - RNA, 1410 nt, Artificial Sequence; identical to SEQ ID NO: 77746
  derived and/or modified sequence opt1 from neuraminidase__InfluenzaA__ACZ05114

SEQ ID NO: 78588 - RNA, 1410 nt, Artificial Sequence; identical to SEQ ID NO: 77746
  derived and/or modified sequence opt1 from neuraminidase__InfluenzaA__ACZ05124

SEQ ID NO: 78589 - RNA, 1410 nt, Artificial Sequence; identical to SEQ ID NO: 77746
  derived and/or modified sequence opt1 from neuraminidase__InfluenzaA__ACZ05144

SEQ ID NO: 78590 - RNA, 1410 nt, Artificial Sequence; identical to SEQ ID NO: 77746
  derived and/or modified sequence opt1 from neuraminidase__InfluenzaA__ACZ05154

SEQ ID NO: 78591 - RNA, 1410 nt, Artificial Sequence; identical to SEQ ID NO: 77607
  derived and/or modified sequence opt1 from neuraminidase__InfluenzaA__ACZ05164

SEQ ID NO: 78592 - RNA, 1410 nt, Artificial Sequence; identical to SEQ ID NO: 77607
  derived and/or modified sequence opt1 from neuraminidase__InfluenzaA__ACZ05175

SEQ ID NO: 78593 - RNA, 1413 nt, Artificial Sequence
  derived and/or modified sequence opt1 from neuraminidase__InfluenzaA__ACZ05197
augaaccccaaccagaagaucaugaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 78594 - RNA, 1410 nt, Artificial Sequence
  derived and/or modified sequence opt1 from neuraminidase__InfluenzaA__ACZ05208
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugcagcgaccccaacaacgaggagggcgggcacggggucaagggcugggccuucgacuccgggaacgacguguggaugggccgcaccaucagcgagaagucccggcucggcuacgagaccuucaaggucaucgagggguggagcaaccccaaguccaagcugcagaucaaccgccaggugaucguggaccggggcaaccgcagcggguacagcggcaucuucuccgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 78595 - RNA, 1410 nt, Artificial Sequence
  derived and/or modified sequence opt1 from neuraminidase__InfluenzaA__ACZ05219
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 78596 - RNA, 1410 nt, Artificial Sequence; identical to SEQ ID NO: 77607
  derived and/or modified sequence opt1 from neuraminidase__InfluenzaA__ACZ05230

SEQ ID NO: 78597 - RNA, 1410 nt, Artificial Sequence
  derived and/or modified sequence opt1 from neuraminidase__InfluenzaA__ACZ05241
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcaagcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 78598 - RNA, 1413 nt, Artificial Sequence
  derived and/or modified sequence opt1 from neuraminidase__InfluenzaA__ACZ05296
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccgguggcgguggacggcgccaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 78599 - RNA, 1410 nt, Artificial Sequence; identical to SEQ ID NO: 77607
  derived and/or modified sequence opt1 from neuraminidase__InfluenzaA__ACZ05307

SEQ ID NO: 78600 - RNA, 1410 nt, Artificial Sequence
  derived and/or modified sequence opt1 from neuraminidase__InfluenzaA__ACZ05318
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 78601 - RNA, 1410 nt, Artificial Sequence; identical to SEQ ID NO: 77607
  derived and/or modified sequence opt1 from neuraminidase__InfluenzaA__ACZ05329

SEQ ID NO: 78602 - RNA, 1410 nt, Artificial Sequence; identical to SEQ ID NO: 77520
  derived and/or modified sequence opt1 from neuraminidase__InfluenzaA__ACZ05340

SEQ ID NO: 78603 - RNA, 1410 nt, Artificial Sequence; identical to SEQ ID NO: 78597
  derived and/or modified sequence opt1 from neuraminidase__InfluenzaA__ACZ05362

SEQ ID NO: 78604 - RNA, 1410 nt, Artificial Sequence; identical to SEQ ID NO: 77607
  derived and/or modified sequence opt1 from neuraminidase__InfluenzaA__ACZ05373

SEQ ID NO: 78605 - RNA, 1410 nt, Artificial Sequence; identical to SEQ ID NO: 77607
  derived and/or modified sequence opt1 from neuraminidase__InfluenzaA__ACZ05395

SEQ ID NO: 78606 - RNA, 1410 nt, Artificial Sequence; identical to SEQ ID NO: 77607
  derived and/or modified sequence opt1 from neuraminidase__InfluenzaA__ACZ05406

SEQ ID NO: 78607 - RNA, 1413 nt, Artificial Sequence
  derived and/or modified sequence opt1 from neuraminidase__InfluenzaA__ACZ05450
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcgugcggaucggguccaagggcgacguguucgucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcggucgccgugcugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggucaccaaguccaucgagcucaacgcccccaacuucuacuacgaggagugcagcugcuacccggacaccggcaucgugaugugcgugugccgggacaacuggcacggguccaaccgccccugggucagcuucaaccagaaccuggacuaccagaucggcuacaucugcuccggcguguucggggacaacccccggcccgaggacggcgaggggagcugcaacccggugaccgucgacggcgcgaacggggugaagggcuucuccuacaaguacggcaacgggguguggaucggccgcaccaagagcaaccggcugcgcaagggguucgagaugaucugggaccccaacggcuggacgaacaccgacuccgacuucagcgucaagcaggacgugguggccaucaccgacuggagcggguacuccggcagcuucguccagcaccccgagcucacgggccuggacugcauccggcccugcuucuggguggagcugguccgcgggcucccgcgggagaacaccaccaucuggaccuccggcagcuccaucagcuucugcggggugaacuccgacacggccaacuggagcuggcccgacggcgccgagcugcccuucaccaucgacaaguga

SEQ ID NO: 78608 - RNA, 1410 nt, Artificial Sequence; identical to SEQ ID NO: 77607
  derived and/or modified sequence opt1 from neuraminidase__InfluenzaA__ACZ05461

SEQ ID NO: 78609 - RNA, 1410 nt, Artificial Sequence; identical to SEQ ID NO: 77607
  derived and/or modified sequence opt1 from neuraminidase__InfluenzaA__ACZ05472

SEQ ID NO: 78610 - RNA, 1410 nt, Artificial Sequence
  derived and/or modified sequence opt1 from neuraminidase__InfluenzaA__ACZ05483
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 78611 - RNA, 1410 nt, Artificial Sequence; identical to SEQ ID NO: 77607
  derived and/or modified sequence opt1 from neuraminidase__InfluenzaA__ACZ05494

SEQ ID NO: 78612 - RNA, 1410 nt, Artificial Sequence; identical to SEQ ID NO: 78600
  derived and/or modified sequence opt1 from neuraminidase__InfluenzaA__ACZ05516

SEQ ID NO: 78613 - RNA, 1410 nt, Artificial Sequence
  derived and/or modified sequence opt1 from neuraminidase__InfluenzaA__ACZ05527
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugcagcgaccccaacaacgaggagggcgggcacggggucaagggcugggccuucgacgacgggaacgacguguggaugggccgcaccaucuccgagaagucccggcucggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 78614 - RNA, 1410 nt, Artificial Sequence; identical to SEQ ID NO: 78597
  derived and/or modified sequence opt1 from neuraminidase__InfluenzaA__ACZ05538

SEQ ID NO: 78615 - RNA, 1413 nt, Artificial Sequence; identical to SEQ ID NO: 78469
  derived and/or modified sequence opt1 from neuraminidase__InfluenzaA__ACZ05593

SEQ ID NO: 78616 - RNA, 1413 nt, Artificial Sequence
  derived and/or modified sequence opt1 from neuraminidase__InfluenzaA__ACZ05604
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccauccggggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucagcgugaagcaggacgucguggccaucaccgacugguccggguacagcggcagcuucgugcagcaccccgagcucacgggccuggacugcauccgccccugcuucugggucgagcuggugcgggggcucccgcgcgagaacaccaccaucuggaccuccggcagcuccaucagcuucugcggggucaacuccgacacggccaacuggagcuggcccgacggcgccgagcugcccuucaccaucgacaaguga

SEQ ID NO: 78617 - RNA, 1410 nt, Artificial Sequence; identical to SEQ ID NO: 77607
  derived and/or modified sequence opt1 from neuraminidase__InfluenzaA__ACZ05953

SEQ ID NO: 78618 - RNA, 1410 nt, Artificial Sequence; identical to SEQ ID NO: 78613
  derived and/or modified sequence opt1 from neuraminidase__InfluenzaA__ACZ05964

SEQ ID NO: 78619 - RNA, 1410 nt, Artificial Sequence; identical to SEQ ID NO: 77607
  derived and/or modified sequence opt1 from neuraminidase__InfluenzaA__ACZ05997

SEQ ID NO: 78620 - RNA, 1410 nt, Artificial Sequence; identical to SEQ ID NO: 78613
  derived and/or modified sequence opt1 from neuraminidase__InfluenzaA__ACZ06008

SEQ ID NO: 78621 - RNA, 1410 nt, Artificial Sequence; identical to SEQ ID NO: 78613
  derived and/or modified sequence opt1 from neuraminidase__InfluenzaA__ACZ06019

SEQ ID NO: 78622 - RNA, 1413 nt, Artificial Sequence
  derived and/or modified sequence opt1 from neuraminidase__InfluenzaA__ACZ16015
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugagcaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucaccggccuggacugcauccggcccugcuucugggucgagcuggugcgcgggcucccgcgggagaacacgaccaucuggaccuccggcagcuccaucagcuucugcggggucaacuccgacaccgccaacuggagcuggcccgacggcgccgagcugcccuucacgaucgacaaguga

SEQ ID NO: 78623 - RNA, 1413 nt, Artificial Sequence
  derived and/or modified sequence opt1 from neuraminidase__InfluenzaA__ACZ16025
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccaucaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 78624 - RNA, 1413 nt, Artificial Sequence; identical to SEQ ID NO: 78469
  derived and/or modified sequence opt1 from neuraminidase__InfluenzaA__ACZ16035

SEQ ID NO: 78625 - RNA, 1410 nt, Artificial Sequence
  derived and/or modified sequence opt1 from neuraminidase__InfluenzaA__ACZ16043
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacaacauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78626 - RNA, 1410 nt, Artificial Sequence
  derived and/or modified sequence opt1 from neuraminidase__InfluenzaA__ACZ16053
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcacgaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 78627 - RNA, 1410 nt, Artificial Sequence; identical to SEQ ID NO: 77736
  derived and/or modified sequence opt1 from neuraminidase__InfluenzaA__ACZ16073

SEQ ID NO: 78628 - RNA, 1410 nt, Artificial Sequence
  derived and/or modified sequence opt1 from neuraminidase__InfluenzaA__ACZ16083
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcgccagagcgucguguccgugaagcuggccggcaacagcucccucugcccggucagcgggugggccaucuacuccaaggacaacagcgugcggaucggcuccaagggcgacguguucgucauccgcgagcccuucaucagcugcagcccccuggggugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggagcugcuucaccgucaugaccgacggcccguccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggaucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 78629 - RNA, 1410 nt, Artificial Sequence; identical to SEQ ID NO: 77736
  derived and/or modified sequence opt1 from neuraminidase__InfluenzaA__ACZ16093

SEQ ID NO: 78630 - RNA, 1410 nt, Artificial Sequence; identical to SEQ ID NO: 77746
  derived and/or modified sequence opt1 from neuraminidase__InfluenzaA__ACZ16103

SEQ ID NO: 78631 - RNA, 1410 nt, Artificial Sequence; identical to SEQ ID NO: 77746
  derived and/or modified sequence opt1 from neuraminidase__InfluenzaA__ACZ16113

SEQ ID NO: 78632 - RNA, 1410 nt, Artificial Sequence; identical to SEQ ID NO: 77746
  derived and/or modified sequence opt1 from neuraminidase__InfluenzaA__ACZ16123

SEQ ID NO: 78633 - RNA, 1410 nt, Artificial Sequence
  derived and/or modified sequence opt1 from neuraminidase__InfluenzaA__ACZ16133
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78634 - RNA, 1410 nt, Artificial Sequence
  derived and/or modified sequence opt1 from neuraminidase__InfluenzaA__ACZ16143
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggcccccuguccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78635 - RNA, 1410 nt, Artificial Sequence; identical to SEQ ID NO: 77746
  derived and/or modified sequence opt1 from neuraminidase__InfluenzaA__ACZ16153

SEQ ID NO: 78636 - RNA, 1410 nt, Artificial Sequence; identical to SEQ ID NO: 77746
  derived and/or modified sequence opt1 from neuraminidase__InfluenzaA__ACZ16163

SEQ ID NO: 78637 - RNA, 1410 nt, Artificial Sequence; identical to SEQ ID NO: 77736
  derived and/or modified sequence opt1 from neuraminidase__InfluenzaA__ACZ16173

SEQ ID NO: 78638 - RNA, 1410 nt, Artificial Sequence; identical to SEQ ID NO: 77746
  derived and/or modified sequence opt1 from neuraminidase__InfluenzaA__ACZ16193

SEQ ID NO: 78639 - RNA, 1410 nt, Artificial Sequence; identical to SEQ ID NO: 77746
  derived and/or modified sequence opt1 from neuraminidase__InfluenzaA__ACZ16203

SEQ ID NO: 78640 - RNA, 1410 nt, Artificial Sequence; identical to SEQ ID NO: 77746
  derived and/or modified sequence opt1 from neuraminidase__InfluenzaA__ACZ16213

SEQ ID NO: 78641 - RNA, 1410 nt, Artificial Sequence
  derived and/or modified sequence opt1 from neuraminidase__InfluenzaA__ACZ16223
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgagaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucaucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 78642 - RNA, 1410 nt, Artificial Sequence; identical to SEQ ID NO: 77746
  derived and/or modified sequence opt1 from neuraminidase__InfluenzaA__ACZ16233

SEQ ID NO: 78643 - RNA, 1410 nt, Artificial Sequence; identical to SEQ ID NO: 78454
  derived and/or modified sequence opt1 from neuraminidase__InfluenzaA__ACZ16243

SEQ ID NO: 78644 - RNA, 1410 nt, Artificial Sequence
  derived and/or modified sequence opt1 from neuraminidase__InfluenzaA__ACZ16253
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaacaucgacaaguga

SEQ ID NO: 78645 - RNA, 1410 nt, Artificial Sequence; identical to SEQ ID NO: 77746
  derived and/or modified sequence opt1 from neuraminidase__InfluenzaA__ACZ16263

SEQ ID NO: 78646 - RNA, 1410 nt, Artificial Sequence; identical to SEQ ID NO: 77736
  derived and/or modified sequence opt1 from neuraminidase__InfluenzaA__ACZ16283

SEQ ID NO: 78647 - RNA, 1410 nt, Artificial Sequence; identical to SEQ ID NO: 77746
  derived and/or modified sequence opt1 from neuraminidase__InfluenzaA__ACZ16293

SEQ ID NO: 78648 - RNA, 1410 nt, Artificial Sequence; identical to SEQ ID NO: 77746
  derived and/or modified sequence opt1 from neuraminidase__InfluenzaA__ACZ16303

SEQ ID NO: 78649 - RNA, 1410 nt, Artificial Sequence; identical to SEQ ID NO: 77746
  derived and/or modified sequence opt1 from neuraminidase__InfluenzaA__ACZ16313

SEQ ID NO: 78650 - RNA, 1410 nt, Artificial Sequence; identical to SEQ ID NO: 77746
  derived and/or modified sequence opt1 from neuraminidase__InfluenzaA__ACZ16323

SEQ ID NO: 78651 - RNA, 1410 nt, Artificial Sequence; identical to SEQ ID NO: 77746
  derived and/or modified sequence opt1 from neuraminidase__InfluenzaA__ACZ16333

SEQ ID NO: 78652 - RNA, 1410 nt, Artificial Sequence; identical to SEQ ID NO: 78454
  derived and/or modified sequence opt1 from neuraminidase__InfluenzaA__ACZ16343

SEQ ID NO: 78653 - RNA, 1410 nt, Artificial Sequence; identical to SEQ ID NO: 77746
  derived and/or modified sequence opt1 from neuraminidase__InfluenzaA__ACZ16353

SEQ ID NO: 78654 - RNA, 1410 nt, Artificial Sequence; identical to SEQ ID NO: 77746
  derived and/or modified sequence opt1 from neuraminidase__InfluenzaA__ACZ16363

SEQ ID NO: 78655 - RNA, 1410 nt, Artificial Sequence; identical to SEQ ID NO: 77736
  derived and/or modified sequence opt1 from neuraminidase__InfluenzaA__ACZ16373

SEQ ID NO: 78656 - RNA, 1410 nt, Artificial Sequence; identical to SEQ ID NO: 77746
  derived and/or modified sequence opt1 from neuraminidase__InfluenzaA__ACZ16383

SEQ ID NO: 78657 - RNA, 1410 nt, Artificial Sequence; identical to SEQ ID NO: 77746
  derived and/or modified sequence opt1 from neuraminidase__InfluenzaA__ACZ16393

SEQ ID NO: 78658 - RNA, 1410 nt, Artificial Sequence; identical to SEQ ID NO: 77746
  derived and/or modified sequence opt1 from neuraminidase__InfluenzaA__ACZ16403

SEQ ID NO: 78659 - RNA, 1410 nt, Artificial Sequence; identical to SEQ ID NO: 77746
  derived and/or modified sequence opt1 from neuraminidase__InfluenzaA__ACZ16423

SEQ ID NO: 78660 - RNA, 1410 nt, Artificial Sequence; identical to SEQ ID NO: 77746
  derived and/or modified sequence opt1 from neuraminidase__InfluenzaA__ACZ16433

SEQ ID NO: 78661 - RNA, 1410 nt, Artificial Sequence; identical to SEQ ID NO: 77746
  derived and/or modified sequence opt1 from neuraminidase__InfluenzaA__ACZ16443

SEQ ID NO: 78662 - RNA, 1410 nt, Artificial Sequence; identical to SEQ ID NO: 77746
  derived and/or modified sequence opt1 from neuraminidase__InfluenzaA__ACZ16453

SEQ ID NO: 78663 - RNA, 1410 nt, Artificial Sequence; identical to SEQ ID NO: 78454
  derived and/or modified sequence opt1 from neuraminidase__InfluenzaA__ACZ16463

SEQ ID NO: 78664 - RNA, 1410 nt, Artificial Sequence; identical to SEQ ID NO: 77746
  derived and/or modified sequence opt1 from neuraminidase__InfluenzaA__ACZ16483

SEQ ID NO: 78665 - RNA, 1410 nt, Artificial Sequence; identical to SEQ ID NO: 77746
  derived and/or modified sequence opt1 from neuraminidase__InfluenzaA__ACZ16493

SEQ ID NO: 78666 - RNA, 1410 nt, Artificial Sequence
  derived and/or modified sequence opt1 from neuraminidase__InfluenzaA__ACZ16503
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagauggacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78667 - RNA, 1410 nt, Artificial Sequence; identical to SEQ ID NO: 78454
  derived and/or modified sequence opt1 from neuraminidase__InfluenzaA__ACZ16513

SEQ ID NO: 78668 - RNA, 1410 nt, Artificial Sequence; identical to SEQ ID NO: 77746
  derived and/or modified sequence opt1 from neuraminidase__InfluenzaA__ACZ16523

SEQ ID NO: 78669 - RNA, 1410 nt, Artificial Sequence; identical to SEQ ID NO: 77746
  derived and/or modified sequence opt1 from neuraminidase__InfluenzaA__ACZ16533

SEQ ID NO: 78670 - RNA, 1410 nt, Artificial Sequence; identical to SEQ ID NO: 77736
  derived and/or modified sequence opt1 from neuraminidase__InfluenzaA__ACZ16543

SEQ ID NO: 78671 - RNA, 1410 nt, Artificial Sequence; identical to SEQ ID NO: 77746
  derived and/or modified sequence opt1 from neuraminidase__InfluenzaA__ACZ16553

SEQ ID NO: 78672 - RNA, 1410 nt, Artificial Sequence; identical to SEQ ID NO: 77746
  derived and/or modified sequence opt1 from neuraminidase__InfluenzaA__ACZ16586

SEQ ID NO: 78673 - RNA, 1410 nt, Artificial Sequence; identical to SEQ ID NO: 77746
  derived and/or modified sequence opt1 from neuraminidase__InfluenzaA__ACZ16596

SEQ ID NO: 78674 - RNA, 1410 nt, Artificial Sequence; identical to SEQ ID NO: 77746
  derived and/or modified sequence opt1 from neuraminidase__InfluenzaA__ACZ16606

SEQ ID NO: 78675 - RNA, 1410 nt, Artificial Sequence; identical to SEQ ID NO: 77746
  derived and/or modified sequence opt1 from neuraminidase__InfluenzaA__ACZ16633

SEQ ID NO: 78676 - RNA, 1410 nt, Artificial Sequence
  derived and/or modified sequence opt1 from neuraminidase__InfluenzaA__ACZ16643
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugcgcuacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 78677 - RNA, 1410 nt, Artificial Sequence; identical to SEQ ID NO: 77746
  derived and/or modified sequence opt1 from neuraminidase__InfluenzaA__ACZ16653

SEQ ID NO: 78678 - RNA, 1410 nt, Artificial Sequence; identical to SEQ ID NO: 77746
  derived and/or modified sequence opt1 from neuraminidase__InfluenzaA__ACZ16663

SEQ ID NO: 78679 - RNA, 1410 nt, Artificial Sequence; identical to SEQ ID NO: 77746
  derived and/or modified sequence opt1 from neuraminidase__InfluenzaA__ACZ16673

SEQ ID NO: 78680 - RNA, 1410 nt, Artificial Sequence; identical to SEQ ID NO: 77746
  derived and/or modified sequence opt1 from neuraminidase__InfluenzaA__ACZ16683

SEQ ID NO: 78681 - RNA, 1410 nt, Artificial Sequence; identical to SEQ ID NO: 77746
  derived and/or modified sequence opt1 from neuraminidase__InfluenzaA__ACZ16693

SEQ ID NO: 78682 - RNA, 1410 nt, Artificial Sequence; identical to SEQ ID NO: 77746
  derived and/or modified sequence opt1 from neuraminidase__InfluenzaA__ACZ16703

SEQ ID NO: 78683 - RNA, 1410 nt, Artificial Sequence; identical to SEQ ID NO: 77746
  derived and/or modified sequence opt1 from neuraminidase__InfluenzaA__ACZ16713

SEQ ID NO: 78684 - RNA, 1410 nt, Artificial Sequence; identical to SEQ ID NO: 77746
  derived and/or modified sequence opt1 from neuraminidase__InfluenzaA__ACZ16723

SEQ ID NO: 78685 - RNA, 1410 nt, Artificial Sequence; identical to SEQ ID NO: 77746
  derived and/or modified sequence opt1 from neuraminidase__InfluenzaA__ACZ16733

SEQ ID NO: 78686 - RNA, 1410 nt, Artificial Sequence; identical to SEQ ID NO: 77746
  derived and/or modified sequence opt1 from neuraminidase__InfluenzaA__ACZ16743

SEQ ID NO: 78687 - RNA, 1410 nt, Artificial Sequence; identical to SEQ ID NO: 77746
  derived and/or modified sequence opt1 from neuraminidase__InfluenzaA__ACZ16753

SEQ ID NO: 78688 - RNA, 1410 nt, Artificial Sequence; identical to SEQ ID NO: 77746
  derived and/or modified sequence opt1 from neuraminidase__InfluenzaA__ACZ16763

SEQ ID NO: 78689 - RNA, 1410 nt, Artificial Sequence; identical to SEQ ID NO: 77736
  derived and/or modified sequence opt1 from neuraminidase__InfluenzaA__ACZ16773

SEQ ID NO: 78690 - RNA, 1410 nt, Artificial Sequence; identical to SEQ ID NO: 77746
  derived and/or modified sequence opt1 from neuraminidase__InfluenzaA__ACZ16783

SEQ ID NO: 78691 - RNA, 1410 nt, Artificial Sequence; identical to SEQ ID NO: 77746
  derived and/or modified sequence opt1 from neuraminidase__InfluenzaA__ACZ16793

SEQ ID NO: 78692 - RNA, 1410 nt, Artificial Sequence; identical to SEQ ID NO: 77746
  derived and/or modified sequence opt1 from neuraminidase__InfluenzaA__ACZ16803

SEQ ID NO: 78693 - RNA, 1410 nt, Artificial Sequence; identical to SEQ ID NO: 77746
  derived and/or modified sequence opt1 from neuraminidase__InfluenzaA__ACZ16813

SEQ ID NO: 78694 - RNA, 1410 nt, Artificial Sequence; identical to SEQ ID NO: 77736
  derived and/or modified sequence opt1 from neuraminidase__InfluenzaA__ACZ16823

SEQ ID NO: 78695 - RNA, 1410 nt, Artificial Sequence; identical to SEQ ID NO: 77746
  derived and/or modified sequence opt1 from neuraminidase__InfluenzaA__ACZ16833

SEQ ID NO: 78696 - RNA, 1410 nt, Artificial Sequence; identical to SEQ ID NO: 77746
  derived and/or modified sequence opt1 from neuraminidase__InfluenzaA__ACZ16843

SEQ ID NO: 78697 - RNA, 1410 nt, Artificial Sequence; identical to SEQ ID NO: 78666
  derived and/or modified sequence opt1 from neuraminidase__InfluenzaA__ACZ16853

SEQ ID NO: 78698 - RNA, 1410 nt, Artificial Sequence; identical to SEQ ID NO: 77746
  derived and/or modified sequence opt1 from neuraminidase__InfluenzaA__ACZ16863

SEQ ID NO: 78699 - RNA, 1410 nt, Artificial Sequence; identical to SEQ ID NO: 77746
  derived and/or modified sequence opt1 from neuraminidase__InfluenzaA__ACZ16873

SEQ ID NO: 78700 - RNA, 1410 nt, Artificial Sequence; identical to SEQ ID NO: 77746
  derived and/or modified sequence opt1 from neuraminidase__InfluenzaA__ACZ16883

SEQ ID NO: 78701 - RNA, 1410 nt, Artificial Sequence; identical to SEQ ID NO: 77746
  derived and/or modified sequence opt1 from neuraminidase__InfluenzaA__ACZ16893

SEQ ID NO: 78702 - RNA, 1410 nt, Artificial Sequence; identical to SEQ ID NO: 77746
  derived and/or modified sequence opt1 from neuraminidase__InfluenzaA__ACZ16903

SEQ ID NO: 78703 - RNA, 1410 nt, Artificial Sequence; identical to SEQ ID NO: 77746
  derived and/or modified sequence opt1 from neuraminidase__InfluenzaA__ACZ16913

SEQ ID NO: 78704 - RNA, 1410 nt, Artificial Sequence; identical to SEQ ID NO: 77746
  derived and/or modified sequence opt1 from neuraminidase__InfluenzaA__ACZ16923

SEQ ID NO: 78705 - RNA, 1410 nt, Artificial Sequence; identical to SEQ ID NO: 77746
  derived and/or modified sequence opt1 from neuraminidase__InfluenzaA__ACZ16933

SEQ ID NO: 78706 - RNA, 1410 nt, Artificial Sequence; identical to SEQ ID NO: 77746
  derived and/or modified sequence opt1 from neuraminidase__InfluenzaA__ACZ16943

SEQ ID NO: 78707 - RNA, 1410 nt, Artificial Sequence; identical to SEQ ID NO: 77736
  derived and/or modified sequence opt1 from neuraminidase__InfluenzaA__ACZ16953

SEQ ID NO: 78708 - RNA, 1410 nt, Artificial Sequence; identical to SEQ ID NO: 77746
  derived and/or modified sequence opt1 from neuraminidase__InfluenzaA__ACZ16963

SEQ ID NO: 78709 - RNA, 1410 nt, Artificial Sequence; identical to SEQ ID NO: 77746
  derived and/or modified sequence opt1 from neuraminidase__InfluenzaA__ACZ16973

SEQ ID NO: 78710 - RNA, 1410 nt, Artificial Sequence; identical to SEQ ID NO: 77746
  derived and/or modified sequence opt1 from neuraminidase__InfluenzaA__ACZ16983

SEQ ID NO: 78711 - RNA, 1410 nt, Artificial Sequence; identical to SEQ ID NO: 77746
  derived and/or modified sequence opt1 from neuraminidase__InfluenzaA__ACZ16993

SEQ ID NO: 78712 - RNA, 1410 nt, Artificial Sequence; identical to SEQ ID NO: 77746
  derived and/or modified sequence opt1 from neuraminidase__InfluenzaA__ACZ17003

SEQ ID NO: 78713 - RNA, 1410 nt, Artificial Sequence; identical to SEQ ID NO: 77746
  derived and/or modified sequence opt1 from neuraminidase__InfluenzaA__ACZ17023

SEQ ID NO: 78714 - RNA, 1410 nt, Artificial Sequence; identical to SEQ ID NO: 77746
  derived and/or modified sequence opt1 from neuraminidase__InfluenzaA__ACZ17043

SEQ ID NO: 78715 - RNA, 1410 nt, Artificial Sequence; identical to SEQ ID NO: 77746
  derived and/or modified sequence opt1 from neuraminidase__InfluenzaA__ACZ17053

SEQ ID NO: 78716 - RNA, 1410 nt, Artificial Sequence
  derived and/or modified sequence opt1 from neuraminidase__InfluenzaA__ACZ17063
augaaccccaaccagaagaucaucaccaucggcagcgugugcaugaccaucgggauggccaaccugauccuccagaucggcaacaucaucuccaucuggaucagccacuccauccagcugggggaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78717 - RNA, 1410 nt, Artificial Sequence; identical to SEQ ID NO: 77746
  derived and/or modified sequence opt1 from neuraminidase__InfluenzaA__ACZ17073

SEQ ID NO: 78718 - RNA, 1410 nt, Artificial Sequence; identical to SEQ ID NO: 78454
  derived and/or modified sequence opt1 from neuraminidase__InfluenzaA__ACZ17083

SEQ ID NO: 78719 - RNA, 1410 nt, Artificial Sequence
  derived and/or modified sequence opt1 from neuraminidase__InfluenzaA__ACZ17093
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcucccccuucgagugccgcaccuucuuccugacccagggcgcccugcucaacgacaagcacagcaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 78720 - RNA, 1410 nt, Artificial Sequence
  derived and/or modified sequence opt1 from neuraminidase__InfluenzaA__ACZ17113
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78721 - RNA, 1410 nt, Artificial Sequence; identical to SEQ ID NO: 77746
  derived and/or modified sequence opt1 from neuraminidase__InfluenzaA__ACZ17123

SEQ ID NO: 78722 - RNA, 1410 nt, Artificial Sequence; identical to SEQ ID NO: 77746
  derived and/or modified sequence opt1 from neuraminidase__InfluenzaA__ACZ17133

SEQ ID NO: 78723 - RNA, 1410 nt, Artificial Sequence
  derived and/or modified sequence opt1 from neuraminidase__InfluenzaA__ACZ17163
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccggaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 78724 - RNA, 1410 nt, Artificial Sequence; identical to SEQ ID NO: 78723
  derived and/or modified sequence opt1 from neuraminidase__InfluenzaA__ACZ17173

SEQ ID NO: 78725 - RNA, 1410 nt, Artificial Sequence; identical to SEQ ID NO: 78723
  derived and/or modified sequence opt1 from neuraminidase__InfluenzaA__ACZ17183

SEQ ID NO: 78726 - RNA, 1410 nt, Artificial Sequence; identical to SEQ ID NO: 78723
  derived and/or modified sequence opt1 from neuraminidase__InfluenzaA__ACZ17193

SEQ ID NO: 78727 - RNA, 1410 nt, Artificial Sequence; identical to SEQ ID NO: 78723
  derived and/or modified sequence opt1 from neuraminidase__InfluenzaA__ACZ17203

SEQ ID NO: 78728 - RNA, 1410 nt, Artificial Sequence; identical to SEQ ID NO: 77746
  derived and/or modified sequence opt1 from neuraminidase__InfluenzaA__ACZ17213

SEQ ID NO: 78729 - RNA, 1410 nt, Artificial Sequence; identical to SEQ ID NO: 77746
  derived and/or modified sequence opt1 from neuraminidase__InfluenzaA__ACZ17223

SEQ ID NO: 78730 - RNA, 1410 nt, Artificial Sequence; identical to SEQ ID NO: 77746
  derived and/or modified sequence opt1 from neuraminidase__InfluenzaA__ACZ17233

SEQ ID NO: 78731 - RNA, 1410 nt, Artificial Sequence; identical to SEQ ID NO: 77746
  derived and/or modified sequence opt1 from neuraminidase__InfluenzaA__ACZ17243

SEQ ID NO: 78732 - RNA, 1410 nt, Artificial Sequence; identical to SEQ ID NO: 77746
  derived and/or modified sequence opt1 from neuraminidase__InfluenzaA__ACZ17263

SEQ ID NO: 78733 - RNA, 1410 nt, Artificial Sequence
  derived and/or modified sequence opt1 from neuraminidase__InfluenzaA__ACZ17273
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacggguucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78734 - RNA, 1410 nt, Artificial Sequence; identical to SEQ ID NO: 77746
  derived and/or modified sequence opt1 from neuraminidase__InfluenzaA__ACZ17283

SEQ ID NO: 78735 - RNA, 1410 nt, Artificial Sequence; identical to SEQ ID NO: 77776
  derived and/or modified sequence opt1 from neuraminidase__InfluenzaA__ACZ17293

SEQ ID NO: 78736 - RNA, 1410 nt, Artificial Sequence; identical to SEQ ID NO: 77776
  derived and/or modified sequence opt1 from neuraminidase__InfluenzaA__ACZ17303

SEQ ID NO: 78737 - RNA, 1410 nt, Artificial Sequence; identical to SEQ ID NO: 77776
  derived and/or modified sequence opt1 from neuraminidase__InfluenzaA__ACZ17313

SEQ ID NO: 78738 - RNA, 1410 nt, Artificial Sequence; identical to SEQ ID NO: 77746
  derived and/or modified sequence opt1 from neuraminidase__InfluenzaA__ACZ17401

SEQ ID NO: 78739 - RNA, 1410 nt, Artificial Sequence; identical to SEQ ID NO: 77746
  derived and/or modified sequence opt1 from neuraminidase__InfluenzaA__ACZ17411

SEQ ID NO: 78740 - RNA, 1410 nt, Artificial Sequence; identical to SEQ ID NO: 77746
  derived and/or modified sequence opt1 from neuraminidase__InfluenzaA__ACZ17421

SEQ ID NO: 78741 - RNA, 1410 nt, Artificial Sequence
  derived and/or modified sequence opt1 from neuraminidase__InfluenzaA__ACZ17431
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucaacagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 78742 - RNA, 1410 nt, Artificial Sequence; identical to SEQ ID NO: 78741
  derived and/or modified sequence opt1 from neuraminidase__InfluenzaA__ACZ17441

SEQ ID NO: 78743 - RNA, 1410 nt, Artificial Sequence; identical to SEQ ID NO: 77736
  derived and/or modified sequence opt1 from neuraminidase__InfluenzaA__ACZ17451

SEQ ID NO: 78744 - RNA, 1410 nt, Artificial Sequence; identical to SEQ ID NO: 77746
  derived and/or modified sequence opt1 from neuraminidase__InfluenzaA__ACZ17461

SEQ ID NO: 78745 - RNA, 1410 nt, Artificial Sequence; identical to SEQ ID NO: 77746
  derived and/or modified sequence opt1 from neuraminidase__InfluenzaA__ACZ17471

SEQ ID NO: 78746 - RNA, 1410 nt, Artificial Sequence; identical to SEQ ID NO: 77776
  derived and/or modified sequence opt1 from neuraminidase__InfluenzaA__ACZ17481

SEQ ID NO: 78747 - RNA, 1410 nt, Artificial Sequence; identical to SEQ ID NO: 77746
  derived and/or modified sequence opt1 from neuraminidase__InfluenzaA__ACZ17491

SEQ ID NO: 78748 - RNA, 1410 nt, Artificial Sequence; identical to SEQ ID NO: 78212
  derived and/or modified sequence opt1 from neuraminidase__InfluenzaA__ACZ27803

SEQ ID NO: 78749 - RNA, 1410 nt, Artificial Sequence; identical to SEQ ID NO: 77736
  derived and/or modified sequence opt1 from neuraminidase__InfluenzaA__ACZ27813

SEQ ID NO: 78750 - RNA, 1410 nt, Artificial Sequence; identical to SEQ ID NO: 77746
  derived and/or modified sequence opt1 from neuraminidase__InfluenzaA__ACZ27823

SEQ ID NO: 78751 - RNA, 1410 nt, Artificial Sequence; identical to SEQ ID NO: 77736
  derived and/or modified sequence opt1 from neuraminidase__InfluenzaA__ACZ27833

SEQ ID NO: 78752 - RNA, 1410 nt, Artificial Sequence; identical to SEQ ID NO: 77746
  derived and/or modified sequence opt1 from neuraminidase__InfluenzaA__ACZ45022

SEQ ID NO: 78753 - RNA, 1410 nt, Artificial Sequence
  derived and/or modified sequence opt1 from neuraminidase__InfluenzaA__ACZ53958
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggaccuacggcacggggagcugcccggacggcuccgugcucaaccugaugcccaucuga

SEQ ID NO: 78754 - RNA, 1410 nt, Artificial Sequence
  derived and/or modified sequence opt1 from neuraminidase__InfluenzaA__ACZ53969
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcgagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagucccgcagcggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggcccgacggcuccgugcugaaccucaugcccaucuga

SEQ ID NO: 78755 - RNA, 1410 nt, Artificial Sequence
  derived and/or modified sequence opt1 from neuraminidase__InfluenzaA__ACZ53980
augaaccccaaccagaacaagcugccgaucggcagcgugucccucaccaucgccaccaucugcuuccugaugcagaucgccauccugaagacgaccgucacccuccacuucaagcaguacgagugcaacagcccgcccaacaaccaggugaugcugugcgagcccaccaucaucgagcgcaaccugacgaagaucguguaccucaccaacaccaccaucaagaaggagaucugccccaagcagcccaaguaccggaacugguccaagcccaagugcaagaucacggagcuggcgcccuucagcaaggacaacuccauccgccugagcgccgggggcgacaucugggucacccgggagccguacguguccugcgaccccgacaagugcuaccaguucgcccucgggcagggcaccacccugaacaacgggcacagcaacgacacggugcacgaccgcacccccuaccggacccugcucaugaacgagcugggcguccccuuccaccugggcaccaagcaggucugcaucgccugguccagcuccagcugccacgacgggaaggccuggcuccacgugugcaucacgggcgacgacaagaacgcgaccgccuccuucaucuacaacgggcgccugguggacagcaucguguccuggagcaaggagauccugcggacccaggaguccgagugcgugugcaucaacgggaccugcacggucgugaugaccgacgggagcgccuccggcaaggccgacaccaagauccucuucaucgaggagggcaagaucgugcacaucagcccgcugagcggguccgcgcagcacgucgaggagugcagcugcuacccccgcuaccccggcgugcggugcaucugccgcgacaacuggaagggguccaaccggcccguggucgacaucaacauggaggacuacagcaucgacuccagcuacgugugcuccggccuggugggcgacaccccgcgcaagaacgacagcuccagcuccagccacugccucgaccccaacaacgaggagggcggccacggggucaagggcugggccuucgacgacgggaacgacguguggaugggccggacgaucuccgagaagcugcgcagcggcuacgagaccuucaaggugaucgggggcugguccaagcccaacagcaagcugcagaucaaccggcaggucaucguggaccgcgggaaccgguccggcuacagcgggaucuucuccgucgagggcaagagcugcaucaaccgcugcuucuacguggagcucauccggggccgcaagcaggagaccgaggugcuguggaccagcaacuccaucgucguguucugcgggacgagcggcaccuacgggaccggcuccuggcccgacgggagcgugcugaaccucaugccgaucuga

SEQ ID NO: 78756 - RNA, 1410 nt, Artificial Sequence; identical to SEQ ID NO: 77746
  derived and/or modified sequence opt1 from neuraminidase__InfluenzaA__ACZ56082

SEQ ID NO: 78757 - RNA, 1410 nt, Artificial Sequence; identical to SEQ ID NO: 78329
  derived and/or modified sequence opt1 from neuraminidase__InfluenzaA__ACZ57183

SEQ ID NO: 78758 - RNA, 1413 nt, Artificial Sequence
  derived and/or modified sequence opt1 from neuraminidase__InfluenzaA__ACZ81542
augaaccccaaccagaaggugaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggucaaccacaccuacgugaacaucaacaacacgaacguggucgcgggggaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggucaccaagagcaucgagcucaacgcccccaacuucuacuacgaggagugcuccugcuacccggacaccggcaucgugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccaacaccgacagcgacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 78759 - RNA, 1413 nt, Artificial Sequence
  derived and/or modified sequence opt1 from neuraminidase__InfluenzaA__ACZ81543
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacaacaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaaggagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaccggcuacaucugcuccggcgucuucggggacaacccccggcccgaggacggcgaggggagcugcaacccggugacgguggacggcgcgaacggggucaagggcuucuccuacaaguacggcaacgggguguggaucggccgcaccaagagcaaccggcugcgcaagggguucgagaugaucugggaccccaacggcuggaccaacaccgacuccgacuucagcgugaagcaggacgucguggccaucacggacugguccggguacagcggcagcuucgugcagcaccccgagcucaccggccuggacugcauccggcccugcuucugggucgagcuggugcgcgggcucccgcgggagaacaccaccaucuggacguccggcagcuccaucagcuucugcggggucaacuccgacaccgccaacuggagcuggcccgacggcgccgagcugcccuucaccaucgacaaguga

SEQ ID NO: 78760 - RNA, 1410 nt, Artificial Sequence
  derived and/or modified sequence opt1 from neuraminidase__InfluenzaA__ACZ81546
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguccgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccacgaccgcaccccguaccggacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcgccugguggacagcguggucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggaccacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagucccgccugggcuacgagaccuucaaggucaucgagggguggagcaaccccaagagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 78761 - RNA, 1410 nt, Artificial Sequence
  derived and/or modified sequence opt1 from neuraminidase__InfluenzaA__ACZ81547
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaccaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggacaagggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 78762 - RNA, 1410 nt, Artificial Sequence; identical to SEQ ID NO: 77746
  derived and/or modified sequence opt1 from neuraminidase__InfluenzaA__ACZ81634

SEQ ID NO: 78763 - RNA, 1410 nt, Artificial Sequence
  derived and/or modified sequence opt1 from neuraminidase__InfluenzaA__ACZ81644
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78764 - RNA, 1410 nt, Artificial Sequence
  derived and/or modified sequence opt1 from neuraminidase__InfluenzaA__ACZ81653
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78765 - RNA, 1410 nt, Artificial Sequence; identical to SEQ ID NO: 77746
  derived and/or modified sequence opt1 from neuraminidase__InfluenzaA__ACZ95840

SEQ ID NO: 78766 - RNA, 1410 nt, Artificial Sequence; identical to SEQ ID NO: 77746
  derived and/or modified sequence opt1 from neuraminidase__InfluenzaA__ACZ95850

SEQ ID NO: 78767 - RNA, 1410 nt, Artificial Sequence; identical to SEQ ID NO: 77746
  derived and/or modified sequence opt1 from neuraminidase__InfluenzaA__ACZ95860

SEQ ID NO: 78768 - RNA, 1410 nt, Artificial Sequence; identical to SEQ ID NO: 77746
  derived and/or modified sequence opt1 from neuraminidase__InfluenzaA__ACZ95870

SEQ ID NO: 78769 - RNA, 1410 nt, Artificial Sequence; identical to SEQ ID NO: 77746
  derived and/or modified sequence opt1 from neuraminidase__InfluenzaA__ACZ95880

SEQ ID NO: 78770 - RNA, 1410 nt, Artificial Sequence; identical to SEQ ID NO: 77746
  derived and/or modified sequence opt1 from neuraminidase__InfluenzaA__ACZ95890

SEQ ID NO: 78771 - RNA, 1410 nt, Artificial Sequence; identical to SEQ ID NO: 77746
  derived and/or modified sequence opt1 from neuraminidase__InfluenzaA__ACZ95900

SEQ ID NO: 78772 - RNA, 1410 nt, Artificial Sequence; identical to SEQ ID NO: 77746
  derived and/or modified sequence opt1 from neuraminidase__InfluenzaA__ACZ95910

SEQ ID NO: 78773 - RNA, 1410 nt, Artificial Sequence; identical to SEQ ID NO: 77746
  derived and/or modified sequence opt1 from neuraminidase__InfluenzaA__ACZ95920

SEQ ID NO: 78774 - RNA, 1410 nt, Artificial Sequence; identical to SEQ ID NO: 78633
  derived and/or modified sequence opt1 from neuraminidase__InfluenzaA__ACZ95930

SEQ ID NO: 78775 - RNA, 1410 nt, Artificial Sequence; identical to SEQ ID NO: 77746
  derived and/or modified sequence opt1 from neuraminidase__InfluenzaA__ACZ95940

SEQ ID NO: 78776 - RNA, 1410 nt, Artificial Sequence; identical to SEQ ID NO: 78763
  derived and/or modified sequence opt1 from neuraminidase__InfluenzaA__ACZ95950

SEQ ID NO: 78777 - RNA, 1410 nt, Artificial Sequence; identical to SEQ ID NO: 77746
  derived and/or modified sequence opt1 from neuraminidase__InfluenzaA__ACZ95960

SEQ ID NO: 78778 - RNA, 1410 nt, Artificial Sequence; identical to SEQ ID NO: 78763
  derived and/or modified sequence opt1 from neuraminidase__InfluenzaA__ACZ95970

SEQ ID NO: 78779 - RNA, 1410 nt, Artificial Sequence; identical to SEQ ID NO: 77746
  derived and/or modified sequence opt1 from neuraminidase__InfluenzaA__ACZ95980

SEQ ID NO: 78780 - RNA, 1410 nt, Artificial Sequence; identical to SEQ ID NO: 77746
  derived and/or modified sequence opt1 from neuraminidase__InfluenzaA__ACZ95990

SEQ ID NO: 78781 - RNA, 1410 nt, Artificial Sequence; identical to SEQ ID NO: 77746
  derived and/or modified sequence opt1 from neuraminidase__InfluenzaA__ACZ96000

SEQ ID NO: 78782 - RNA, 1410 nt, Artificial Sequence; identical to SEQ ID NO: 77746
  derived and/or modified sequence opt1 from neuraminidase__InfluenzaA__ACZ96010

SEQ ID NO: 78783 - RNA, 1410 nt, Artificial Sequence
  derived and/or modified sequence opt1 from neuraminidase__InfluenzaA__ACZ96020
augaaccccaaccagaagaucaucaccaucggcagcgugugcaugaccaucgggauggccaaccugauccuccagaucggcaacaucauccugaucuggaucucccacagcauccagcuggggaaccagaaccagacggagaccugcaaccaguccgucaucaccuacgagaacaacaccugggugaaccagacguacgugaacaucagcaacaccaacuucgccgcgggccaguccgucgugagcgugaagcucgccgggaacuccagccugugcccggucuccggcugggccaucuacagcaaggacaacuccgugcgcaucggcagcaagggggacguguucgucauccgggagcccuucaucuccugcagcccccuggagugccgcaccuucuuccucacccagggcgcccugcugaacgacaagcacuccaacgggacgaucaaggaccggagccccuaccgcacccucauguccugcccgaucggcgaggugcccagccccuacaacucccgguucgagagcguggccuggagcgcguccgccugccacgacgggaucaacuggcugaccaucggcaucagcggccccgacaacggggccgucgccgugcugaaguacaacggcaucaucaccgacacgaucaaguccuggcgcaacaacauccuccggacccaggagagcgagugcgcgugcgugaacggguccugcuucaccgucaugaccgacggcccgagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcaucuucggggacaacccgcggcccaucgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucguccagcacccggagcugaccggccucgacugcauccgccccugcuucuggguggagcugauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 78784 - RNA, 1410 nt, Artificial Sequence; identical to SEQ ID NO: 77746
  derived and/or modified sequence opt1 from neuraminidase__InfluenzaA__ACZ96050

SEQ ID NO: 78785 - RNA, 1410 nt, Artificial Sequence; identical to SEQ ID NO: 77746
  derived and/or modified sequence opt1 from neuraminidase__InfluenzaA__ACZ96060

SEQ ID NO: 78786 - RNA, 1410 nt, Artificial Sequence; identical to SEQ ID NO: 77746
  derived and/or modified sequence opt1 from neuraminidase__InfluenzaA__ACZ96072

SEQ ID NO: 78787 - RNA, 1410 nt, Artificial Sequence; identical to SEQ ID NO: 77746
  derived and/or modified sequence opt1 from neuraminidase__InfluenzaA__ACZ96082

SEQ ID NO: 78788 - RNA, 1410 nt, Artificial Sequence; identical to SEQ ID NO: 77746
  derived and/or modified sequence opt1 from neuraminidase__InfluenzaA__ACZ96092

SEQ ID NO: 78789 - RNA, 1410 nt, Artificial Sequence; identical to SEQ ID NO: 77746
  derived and/or modified sequence opt1 from neuraminidase__InfluenzaA__ACZ96102

SEQ ID NO: 78790 - RNA, 1410 nt, Artificial Sequence; identical to SEQ ID NO: 77746
  derived and/or modified sequence opt1 from neuraminidase__InfluenzaA__ACZ96112

SEQ ID NO: 78791 - RNA, 1410 nt, Artificial Sequence
  derived and/or modified sequence opt1 from neuraminidase__InfluenzaA__ACZ96122
augaaccccaaccagaagaucaucaccaucggcagcgugugcaugaccaucgggauggccaaccugauccuccagaucggcaacaucaucuccaucuggaucagccacuccauccagcuggggaaccagaaccagaucgaggccugcaaccagagcgucaucacguacgagaacaacaccugggugaaccagaccuacgugaacaucuccaacaccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaaggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggacgagcggguccagcaucuccuucugcggcaucaacagcgacaccguggggugguccuggcccgacggcgcggagcugccguucaccaucgacaaguga

SEQ ID NO: 78792 - RNA, 1410 nt, Artificial Sequence; identical to SEQ ID NO: 77746
  derived and/or modified sequence opt1 from neuraminidase__InfluenzaA__ACZ96132

SEQ ID NO: 78793 - RNA, 1410 nt, Artificial Sequence; identical to SEQ ID NO: 77746
  derived and/or modified sequence opt1 from neuraminidase__InfluenzaA__ACZ96142

SEQ ID NO: 78794 - RNA, 1410 nt, Artificial Sequence; identical to SEQ ID NO: 77746
  derived and/or modified sequence opt1 from neuraminidase__InfluenzaA__ACZ96152

SEQ ID NO: 78795 - RNA, 1410 nt, Artificial Sequence; identical to SEQ ID NO: 77746
  derived and/or modified sequence opt1 from neuraminidase__InfluenzaA__ACZ96162

SEQ ID NO: 78796 - RNA, 1410 nt, Artificial Sequence; identical to SEQ ID NO: 77746
  derived and/or modified sequence opt1 from neuraminidase__InfluenzaA__ACZ96172

SEQ ID NO: 78797 - RNA, 1410 nt, Artificial Sequence
  derived and/or modified sequence opt1 from neuraminidase__InfluenzaA__ACZ96182
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgaccggcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 78798 - RNA, 1410 nt, Artificial Sequence
  derived and/or modified sequence opt1 from neuraminidase__InfluenzaA__ACZ96192
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggagcaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 78799 - RNA, 1410 nt, Artificial Sequence
  derived and/or modified sequence opt1 from neuraminidase__InfluenzaA__ACZ96232
augaaccccaaccagaagaucaucaccaucggcagcgugugcaugaccgucgggauggccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacgacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78800 - RNA, 1410 nt, Artificial Sequence
  derived and/or modified sequence opt1 from neuraminidase__InfluenzaA__ACZ96242
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagagcaccaucuggaccuccgggagcuccaucagcuucugcggcgugaacuccgacaccgucggguggagcuggcccgacggcgccgagcugccguucacgaucgacaaguga

SEQ ID NO: 78801 - RNA, 1410 nt, Artificial Sequence; identical to SEQ ID NO: 77746
  derived and/or modified sequence opt1 from neuraminidase__InfluenzaA__ACZ96252

SEQ ID NO: 78802 - RNA, 1410 nt, Artificial Sequence; identical to SEQ ID NO: 77746
  derived and/or modified sequence opt1 from neuraminidase__InfluenzaA__ACZ96292

SEQ ID NO: 78803 - RNA, 1410 nt, Artificial Sequence; identical to SEQ ID NO: 77746
  derived and/or modified sequence opt1 from neuraminidase__InfluenzaA__ACZ96302

SEQ ID NO: 78804 - RNA, 1410 nt, Artificial Sequence; identical to SEQ ID NO: 77746
  derived and/or modified sequence opt1 from neuraminidase__InfluenzaA__ACZ96312

SEQ ID NO: 78805 - RNA, 1410 nt, Artificial Sequence
  derived and/or modified sequence opt1 from neuraminidase__InfluenzaA__ACZ96322
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugaccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 78806 - RNA, 1410 nt, Artificial Sequence; identical to SEQ ID NO: 78805
  derived and/or modified sequence opt1 from neuraminidase__InfluenzaA__ACZ96332

SEQ ID NO: 78807 - RNA, 1410 nt, Artificial Sequence; identical to SEQ ID NO: 77746
  derived and/or modified sequence opt1 from neuraminidase__InfluenzaA__ACZ96352

SEQ ID NO: 78808 - RNA, 1410 nt, Artificial Sequence; identical to SEQ ID NO: 78805
  derived and/or modified sequence opt1 from neuraminidase__InfluenzaA__ACZ96362

SEQ ID NO: 78809 - RNA, 1410 nt, Artificial Sequence; identical to SEQ ID NO: 77746
  derived and/or modified sequence opt1 from neuraminidase__InfluenzaA__ACZ96375

SEQ ID NO: 78810 - RNA, 1410 nt, Artificial Sequence; identical to SEQ ID NO: 78805
  derived and/or modified sequence opt1 from neuraminidase__InfluenzaA__ACZ96385

SEQ ID NO: 78811 - RNA, 1410 nt, Artificial Sequence
  derived and/or modified sequence opt1 from neuraminidase__InfluenzaA__ACZ96395
augaaccccaaccagaagaucaucaccaucggcagcgugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaucgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 78812 - RNA, 1410 nt, Artificial Sequence; identical to SEQ ID NO: 77746
  derived and/or modified sequence opt1 from neuraminidase__InfluenzaA__ACZ96408

SEQ ID NO: 78813 - RNA, 1410 nt, Artificial Sequence; identical to SEQ ID NO: 77746
  derived and/or modified sequence opt1 from neuraminidase__InfluenzaA__ACZ96428

SEQ ID NO: 78814 - RNA, 1410 nt, Artificial Sequence; identical to SEQ ID NO: 77746
  derived and/or modified sequence opt1 from neuraminidase__InfluenzaA__ACZ96438

SEQ ID NO: 78815 - RNA, 1410 nt, Artificial Sequence; identical to SEQ ID NO: 77746
  derived and/or modified sequence opt1 from neuraminidase__InfluenzaA__ACZ96448

SEQ ID NO: 78816 - RNA, 1410 nt, Artificial Sequence; identical to SEQ ID NO: 77746
  derived and/or modified sequence opt1 from neuraminidase__InfluenzaA__ACZ96479

SEQ ID NO: 78817 - RNA, 1410 nt, Artificial Sequence; identical to SEQ ID NO: 78763
  derived and/or modified sequence opt1 from neuraminidase__InfluenzaA__ACZ96489

SEQ ID NO: 78818 - RNA, 1410 nt, Artificial Sequence; identical to SEQ ID NO: 77746
  derived and/or modified sequence opt1 from neuraminidase__InfluenzaA__ACZ96499

SEQ ID NO: 78819 - RNA, 1410 nt, Artificial Sequence
  derived and/or modified sequence opt1 from neuraminidase__InfluenzaA__ACZ96509
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccuggaucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78820 - RNA, 1410 nt, Artificial Sequence; identical to SEQ ID NO: 77746
  derived and/or modified sequence opt1 from neuraminidase__InfluenzaA__ACZ96519

SEQ ID NO: 78821 - RNA, 1410 nt, Artificial Sequence; identical to SEQ ID NO: 77746
  derived and/or modified sequence opt1 from neuraminidase__InfluenzaA__ACZ96529

SEQ ID NO: 78822 - RNA, 1410 nt, Artificial Sequence
  derived and/or modified sequence opt1 from neuraminidase__InfluenzaA__ACZ96552
augaaccccaaccagaagaucaucaccaucggcagcgugugcaugaccaucgggauggccaaccugauccuccagaucggcaacaucaucuccaucuggaucagccacuccagccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78823 - RNA, 1410 nt, Artificial Sequence; identical to SEQ ID NO: 77746
  derived and/or modified sequence opt1 from neuraminidase__InfluenzaA__ACZ96562

SEQ ID NO: 78824 - RNA, 1410 nt, Artificial Sequence; identical to SEQ ID NO: 77746
  derived and/or modified sequence opt1 from neuraminidase__InfluenzaA__ACZ96572

SEQ ID NO: 78825 - RNA, 1410 nt, Artificial Sequence; identical to SEQ ID NO: 77746
  derived and/or modified sequence opt1 from neuraminidase__InfluenzaA__ACZ96582

SEQ ID NO: 78826 - RNA, 1410 nt, Artificial Sequence
  derived and/or modified sequence opt1 from neuraminidase__InfluenzaA__ACZ96592
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccagagcuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 78827 - RNA, 1410 nt, Artificial Sequence; identical to SEQ ID NO: 77746
  derived and/or modified sequence opt1 from neuraminidase__InfluenzaA__ACZ96602

SEQ ID NO: 78828 - RNA, 1410 nt, Artificial Sequence
  derived and/or modified sequence opt1 from neuraminidase__InfluenzaA__ACZ96612
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucgugaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 78829 - RNA, 1410 nt, Artificial Sequence; identical to SEQ ID NO: 77776
  derived and/or modified sequence opt1 from neuraminidase__InfluenzaA__ACZ96622

SEQ ID NO: 78830 - RNA, 1410 nt, Artificial Sequence; identical to SEQ ID NO: 77776
  derived and/or modified sequence opt1 from neuraminidase__InfluenzaA__ACZ96632

SEQ ID NO: 78831 - RNA, 1410 nt, Artificial Sequence; identical to SEQ ID NO: 77776
  derived and/or modified sequence opt1 from neuraminidase__InfluenzaA__ACZ96642

SEQ ID NO: 78832 - RNA, 1410 nt, Artificial Sequence; identical to SEQ ID NO: 77776
  derived and/or modified sequence opt1 from neuraminidase__InfluenzaA__ACZ96652

SEQ ID NO: 78833 - RNA, 1410 nt, Artificial Sequence; identical to SEQ ID NO: 77776
  derived and/or modified sequence opt1 from neuraminidase__InfluenzaA__ACZ96662

SEQ ID NO: 78834 - RNA, 1410 nt, Artificial Sequence; identical to SEQ ID NO: 77776
  derived and/or modified sequence opt1 from neuraminidase__InfluenzaA__ACZ96672

SEQ ID NO: 78835 - RNA, 1410 nt, Artificial Sequence; identical to SEQ ID NO: 77776
  derived and/or modified sequence opt1 from neuraminidase__InfluenzaA__ACZ96682

SEQ ID NO: 78836 - RNA, 1410 nt, Artificial Sequence; identical to SEQ ID NO: 77776
  derived and/or modified sequence opt1 from neuraminidase__InfluenzaA__ACZ96692

SEQ ID NO: 78837 - RNA, 1410 nt, Artificial Sequence; identical to SEQ ID NO: 77776
  derived and/or modified sequence opt1 from neuraminidase__InfluenzaA__ACZ96702

SEQ ID NO: 78838 - RNA, 1410 nt, Artificial Sequence; identical to SEQ ID NO: 77776
  derived and/or modified sequence opt1 from neuraminidase__InfluenzaA__ACZ96712

SEQ ID NO: 78839 - RNA, 1410 nt, Artificial Sequence; identical to SEQ ID NO: 77776
  derived and/or modified sequence opt1 from neuraminidase__InfluenzaA__ACZ96722

SEQ ID NO: 78840 - RNA, 1410 nt, Artificial Sequence; identical to SEQ ID NO: 77776
  derived and/or modified sequence opt1 from neuraminidase__InfluenzaA__ACZ96732

SEQ ID NO: 78841 - RNA, 1410 nt, Artificial Sequence; identical to SEQ ID NO: 77776
  derived and/or modified sequence opt1 from neuraminidase__InfluenzaA__ACZ96742

SEQ ID NO: 78842 - RNA, 1410 nt, Artificial Sequence; identical to SEQ ID NO: 77736
  derived and/or modified sequence opt1 from neuraminidase__InfluenzaA__ACZ96752

SEQ ID NO: 78843 - RNA, 1410 nt, Artificial Sequence; identical to SEQ ID NO: 77736
  derived and/or modified sequence opt1 from neuraminidase__InfluenzaA__ACZ96762

SEQ ID NO: 78844 - RNA, 1410 nt, Artificial Sequence; identical to SEQ ID NO: 77736
  derived and/or modified sequence opt1 from neuraminidase__InfluenzaA__ACZ96772

SEQ ID NO: 78845 - RNA, 1410 nt, Artificial Sequence; identical to SEQ ID NO: 77736
  derived and/or modified sequence opt1 from neuraminidase__InfluenzaA__ACZ96782

SEQ ID NO: 78846 - RNA, 1410 nt, Artificial Sequence; identical to SEQ ID NO: 77736
  derived and/or modified sequence opt1 from neuraminidase__InfluenzaA__ACZ96792

SEQ ID NO: 78847 - RNA, 1410 nt, Artificial Sequence; identical to SEQ ID NO: 77746
  derived and/or modified sequence opt1 from neuraminidase__InfluenzaA__ACZ96802

SEQ ID NO: 78848 - RNA, 1410 nt, Artificial Sequence; identical to SEQ ID NO: 77746
  derived and/or modified sequence opt1 from neuraminidase__InfluenzaA__ACZ96812

SEQ ID NO: 78849 - RNA, 1410 nt, Artificial Sequence; identical to SEQ ID NO: 78329
  derived and/or modified sequence opt1 from neuraminidase__InfluenzaA__ACZ96822

SEQ ID NO: 78850 - RNA, 1410 nt, Artificial Sequence
  derived and/or modified sequence opt1 from neuraminidase__InfluenzaA__ACZ96842
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaucgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78851 - RNA, 1410 nt, Artificial Sequence; identical to SEQ ID NO: 77746
  derived and/or modified sequence opt1 from neuraminidase__InfluenzaA__ACZ96852

SEQ ID NO: 78852 - RNA, 1410 nt, Artificial Sequence; identical to SEQ ID NO: 77746
  derived and/or modified sequence opt1 from neuraminidase__InfluenzaA__ACZ96862

SEQ ID NO: 78853 - RNA, 1410 nt, Artificial Sequence
  derived and/or modified sequence opt1 from neuraminidase__InfluenzaA__ACZ96872
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78854 - RNA, 1410 nt, Artificial Sequence; identical to SEQ ID NO: 77736
  derived and/or modified sequence opt1 from neuraminidase__InfluenzaA__ACZ96882

SEQ ID NO: 78855 - RNA, 1410 nt, Artificial Sequence; identical to SEQ ID NO: 78853
  derived and/or modified sequence opt1 from neuraminidase__InfluenzaA__ACZ96892

SEQ ID NO: 78856 - RNA, 1410 nt, Artificial Sequence; identical to SEQ ID NO: 78853
  derived and/or modified sequence opt1 from neuraminidase__InfluenzaA__ACZ96902

SEQ ID NO: 78857 - RNA, 1410 nt, Artificial Sequence; identical to SEQ ID NO: 77736
  derived and/or modified sequence opt1 from neuraminidase__InfluenzaA__ACZ96912

SEQ ID NO: 78858 - RNA, 1410 nt, Artificial Sequence; identical to SEQ ID NO: 77736
  derived and/or modified sequence opt1 from neuraminidase__InfluenzaA__ACZ96922

SEQ ID NO: 78859 - RNA, 1410 nt, Artificial Sequence; identical to SEQ ID NO: 78853
  derived and/or modified sequence opt1 from neuraminidase__InfluenzaA__ACZ96932

SEQ ID NO: 78860 - RNA, 1410 nt, Artificial Sequence; identical to SEQ ID NO: 78853
  derived and/or modified sequence opt1 from neuraminidase__InfluenzaA__ACZ96942

SEQ ID NO: 78861 - RNA, 1410 nt, Artificial Sequence; identical to SEQ ID NO: 77736
  derived and/or modified sequence opt1 from neuraminidase__InfluenzaA__ACZ96952

SEQ ID NO: 78862 - RNA, 1410 nt, Artificial Sequence; identical to SEQ ID NO: 77736
  derived and/or modified sequence opt1 from neuraminidase__InfluenzaA__ACZ97024

SEQ ID NO: 78863 - RNA, 1410 nt, Artificial Sequence; identical to SEQ ID NO: 78853
  derived and/or modified sequence opt1 from neuraminidase__InfluenzaA__ACZ97336

SEQ ID NO: 78864 - RNA, 1410 nt, Artificial Sequence; identical to SEQ ID NO: 78853
  derived and/or modified sequence opt1 from neuraminidase__InfluenzaA__ACZ97346

SEQ ID NO: 78865 - RNA, 1410 nt, Artificial Sequence; identical to SEQ ID NO: 77746
  derived and/or modified sequence opt1 from neuraminidase__InfluenzaA__ACZ97366

SEQ ID NO: 78866 - RNA, 1410 nt, Artificial Sequence; identical to SEQ ID NO: 77746
  derived and/or modified sequence opt1 from neuraminidase__InfluenzaA__ACZ97376

SEQ ID NO: 78867 - RNA, 1410 nt, Artificial Sequence; identical to SEQ ID NO: 77746
  derived and/or modified sequence opt1 from neuraminidase__InfluenzaA__ACZ97386

SEQ ID NO: 78868 - RNA, 1410 nt, Artificial Sequence; identical to SEQ ID NO: 78853
  derived and/or modified sequence opt1 from neuraminidase__InfluenzaA__ACZ97396

SEQ ID NO: 78869 - RNA, 1410 nt, Artificial Sequence; identical to SEQ ID NO: 77746
  derived and/or modified sequence opt1 from neuraminidase__InfluenzaA__ACZ98171

SEQ ID NO: 78870 - RNA, 1410 nt, Artificial Sequence; identical to SEQ ID NO: 77746
  derived and/or modified sequence opt1 from neuraminidase__InfluenzaA__ACZ98181

SEQ ID NO: 78871 - RNA, 1410 nt, Artificial Sequence
  derived and/or modified sequence opt1 from neuraminidase__InfluenzaA__ACZ98191
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucuccuacgagaacaacaccugggugaaccagaccuacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 78872 - RNA, 1410 nt, Artificial Sequence; identical to SEQ ID NO: 77736
  derived and/or modified sequence opt1 from neuraminidase__InfluenzaA__ACZ98201

SEQ ID NO: 78873 - RNA, 1410 nt, Artificial Sequence; identical to SEQ ID NO: 77746
  derived and/or modified sequence opt1 from neuraminidase__InfluenzaA__ACZ98211

SEQ ID NO: 78874 - RNA, 1410 nt, Artificial Sequence; identical to SEQ ID NO: 77746
  derived and/or modified sequence opt1 from neuraminidase__InfluenzaA__ACZ98221

SEQ ID NO: 78875 - RNA, 1410 nt, Artificial Sequence; identical to SEQ ID NO: 77746
  derived and/or modified sequence opt1 from neuraminidase__InfluenzaA__ACZ98231

SEQ ID NO: 78876 - RNA, 1410 nt, Artificial Sequence; identical to SEQ ID NO: 77746
  derived and/or modified sequence opt1 from neuraminidase__InfluenzaA__ACZ98241

SEQ ID NO: 78877 - RNA, 1410 nt, Artificial Sequence; identical to SEQ ID NO: 78723
  derived and/or modified sequence opt1 from neuraminidase__InfluenzaA__ACZ98251

SEQ ID NO: 78878 - RNA, 1410 nt, Artificial Sequence; identical to SEQ ID NO: 77746
  derived and/or modified sequence opt1 from neuraminidase__InfluenzaA__ACZ98261

SEQ ID NO: 78879 - RNA, 1410 nt, Artificial Sequence; identical to SEQ ID NO: 77746
  derived and/or modified sequence opt1 from neuraminidase__InfluenzaA__ACZ98271

SEQ ID NO: 78880 - RNA, 1410 nt, Artificial Sequence; identical to SEQ ID NO: 77746
  derived and/or modified sequence opt1 from neuraminidase__InfluenzaA__ACZ98281

SEQ ID NO: 78881 - RNA, 1410 nt, Artificial Sequence; identical to SEQ ID NO: 77746
  derived and/or modified sequence opt1 from neuraminidase__InfluenzaA__ACZ98291

SEQ ID NO: 78882 - RNA, 1410 nt, Artificial Sequence; identical to SEQ ID NO: 77736
  derived and/or modified sequence opt1 from neuraminidase__InfluenzaA__ACZ98301

SEQ ID NO: 78883 - RNA, 1410 nt, Artificial Sequence
  derived and/or modified sequence opt1 from neuraminidase__InfluenzaA__ACZ98321
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucaacagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78884 - RNA, 1410 nt, Artificial Sequence; identical to SEQ ID NO: 77746
  derived and/or modified sequence opt1 from neuraminidase__InfluenzaA__ACZ98331

SEQ ID NO: 78885 - RNA, 1410 nt, Artificial Sequence
  derived and/or modified sequence opt1 from neuraminidase__InfluenzaA__ACZ98341
augaaccccaaccagaagaucaucaccaucggcagcgugugcaucaccaucgggauggccaaccugauccuccagaucggcaacaucaucuccaucuggaucagccacccgauccagcuggggaaccagaaccagaucgagacgugcaaccaguccgucaucaccuacgagaacaacaccugggugaaccagaccuacgugaacaucagcaacacgaaccuggccgcgggccaguccgucgugagcgugaagcucgccgggaacuccagccugugccccgucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagcccguaccgcacgcucauguccugccccaucggcgagguccccagccccuacaacucccgguucgagagcguggccuggagcgcguccgccugccacgacgggaucaacuggcugaccaucggcaucagcggcccggacaacggggccguggccguccugaaguacaacggcaucaucaccgacaccaucaaguccuggcgcaacaacauccuccggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccuggaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccucgacugcauccgccccugcuucugggucgagcugauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 78886 - RNA, 1410 nt, Artificial Sequence; identical to SEQ ID NO: 77746
  derived and/or modified sequence opt1 from neuraminidase__InfluenzaA__ACZ98351

SEQ ID NO: 78887 - RNA, 1410 nt, Artificial Sequence; identical to SEQ ID NO: 77746
  derived and/or modified sequence opt1 from neuraminidase__InfluenzaA__ACZ98361

SEQ ID NO: 78888 - RNA, 1410 nt, Artificial Sequence; identical to SEQ ID NO: 77746
  derived and/or modified sequence opt1 from neuraminidase__InfluenzaA__ACZ98371

SEQ ID NO: 78889 - RNA, 1410 nt, Artificial Sequence; identical to SEQ ID NO: 77746
  derived and/or modified sequence opt1 from neuraminidase__InfluenzaA__ACZ98381

SEQ ID NO: 78890 - RNA, 1410 nt, Artificial Sequence; identical to SEQ ID NO: 77746
  derived and/or modified sequence opt1 from neuraminidase__InfluenzaA__ACZ98391

SEQ ID NO: 78891 - RNA, 1410 nt, Artificial Sequence; identical to SEQ ID NO: 77746
  derived and/or modified sequence opt1 from neuraminidase__InfluenzaA__ACZ98401

SEQ ID NO: 78892 - RNA, 1410 nt, Artificial Sequence; identical to SEQ ID NO: 77746
  derived and/or modified sequence opt1 from neuraminidase__InfluenzaA__ACZ98411

SEQ ID NO: 78893 - RNA, 1410 nt, Artificial Sequence; identical to SEQ ID NO: 77776
  derived and/or modified sequence opt1 from neuraminidase__InfluenzaA__ACZ98421

SEQ ID NO: 78894 - RNA, 1410 nt, Artificial Sequence; identical to SEQ ID NO: 77746
  derived and/or modified sequence opt1 from neuraminidase__InfluenzaA__ACZ98431

SEQ ID NO: 78895 - RNA, 1410 nt, Artificial Sequence; identical to SEQ ID NO: 77746
  derived and/or modified sequence opt1 from neuraminidase__InfluenzaA__ACZ98441

SEQ ID NO: 78896 - RNA, 1410 nt, Artificial Sequence; identical to SEQ ID NO: 77746
  derived and/or modified sequence opt1 from neuraminidase__InfluenzaA__ACZ98451

SEQ ID NO: 78897 - RNA, 1410 nt, Artificial Sequence; identical to SEQ ID NO: 77746
  derived and/or modified sequence opt1 from neuraminidase__InfluenzaA__ACZ98461

SEQ ID NO: 78898 - RNA, 1410 nt, Artificial Sequence; identical to SEQ ID NO: 78329
  derived and/or modified sequence opt1 from neuraminidase__InfluenzaA__ACZ98674

SEQ ID NO: 78899 - RNA, 1410 nt, Artificial Sequence; identical to SEQ ID NO: 78853
  derived and/or modified sequence opt1 from neuraminidase__InfluenzaA__ACZ98684

SEQ ID NO: 78900 - RNA, 1410 nt, Artificial Sequence; identical to SEQ ID NO: 78799
  derived and/or modified sequence opt1 from neuraminidase__InfluenzaA__ACZ98694

SEQ ID NO: 78901 - RNA, 1410 nt, Artificial Sequence; identical to SEQ ID NO: 77746
  derived and/or modified sequence opt1 from neuraminidase__InfluenzaA__ADA60801

SEQ ID NO: 78902 - RNA, 1410 nt, Artificial Sequence; identical to SEQ ID NO: 77746
  derived and/or modified sequence opt1 from neuraminidase__InfluenzaA__ADA69294

SEQ ID NO: 78903 - RNA, 1410 nt, Artificial Sequence; identical to SEQ ID NO: 77746
  derived and/or modified sequence opt1 from neuraminidase__InfluenzaA__ADA69304

SEQ ID NO: 78904 - RNA, 1410 nt, Artificial Sequence; identical to SEQ ID NO: 77746
  derived and/or modified sequence opt1 from neuraminidase__InfluenzaA__ADA69314

SEQ ID NO: 78905 - RNA, 1410 nt, Artificial Sequence; identical to SEQ ID NO: 77746
  derived and/or modified sequence opt1 from neuraminidase__InfluenzaA__ADA69324

SEQ ID NO: 78906 - RNA, 1410 nt, Artificial Sequence; identical to SEQ ID NO: 77746
  derived and/or modified sequence opt1 from neuraminidase__InfluenzaA__ADA69334

SEQ ID NO: 78907 - RNA, 1410 nt, Artificial Sequence; identical to SEQ ID NO: 77746
  derived and/or modified sequence opt1 from neuraminidase__InfluenzaA__ADA69451

SEQ ID NO: 78908 - RNA, 1410 nt, Artificial Sequence; identical to SEQ ID NO: 77746
  derived and/or modified sequence opt1 from neuraminidase__InfluenzaA__ADA69453

SEQ ID NO: 78909 - RNA, 1410 nt, Artificial Sequence
  derived and/or modified sequence opt1 from neuraminidase__InfluenzaA__ADA71153
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagccgguacgugugcuccggccuggucggcgacccgccccgcaagaacgacagcuccagcuccagccacugccucgaccccaacaacgaggagggcgggcacggggugaagggcugggccuucgacgacgggaacgacgucuggaugggccggaccaucuccgagaagucccgccugggcuacgagaccuucaaggugaucgagggguggagcaaccccaagagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagacggagguccuguggaccagcaacuccaucgugguguucugcggcaccagcgggaccuacggcacgggguccuggcccgacggcgccaacaucaaccugaugcccaucuga

SEQ ID NO: 78910 - RNA, 1413 nt, Artificial Sequence
  derived and/or modified sequence opt1 from neuraminidase__InfluenzaA__ADA71155
augaaccccaaccagaagaucaucaccaucggcagcaucuccaucgccaucgggaucaucagccugaugcuccagaucggcaacaucaucuccaucugggccagccacuccauccagaucgggagccagaacaacaccggcaucugcaaccagcgcaucaucacguacgagaacuccaccugggugaaccacaccuacgucaacaucaacaacaccaaggugguggcgggggaggacaagacgagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 78911 - RNA, 1413 nt, Artificial Sequence; identical to SEQ ID NO: 78469
  derived and/or modified sequence opt1 from neuraminidase__InfluenzaA__ADA71157

SEQ ID NO: 78912 - RNA, 1413 nt, Artificial Sequence
  derived and/or modified sequence opt1 from neuraminidase__InfluenzaA__ADA71159
augaaccccaaccagaagaucaucaccaucggcagcaucuccaucgccaucgggaucaucagccugaugcuccagaucggcaacaucaucuccaucugggccagccacuccauccagaucgggagccagaacaacaccggcaucugcaaccagcgcaucaucacguacgagaacuccaccugggugaaccacaccuacgucaacaucaacaacaccaaggugguggcgggggagggcaagacgagcgucacccuggccggcaacuccagccugugcuccaucagcgggugggccaucaacaccaaggacaacuccauccggaucggcagcaagggggacguguucgugauccgcgagccguucaucuccugcagccaccucgagugccggaccuucuuccugacgcagggcgcccugcucaacgacaagcacuccaaccgcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcggacccaggagagcgagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgcgacaacuggcacgggagcaaccggcccuggguguccuucaaccagaaccuggacuaccagaucggcuacaucugcagcggcgucuucggggacaacccccgccccgaggacggcgagggguccugcaacccggugaccguggacggcgcgaacggggucaagggcuucagcuacaaguacggcaacgggguguggaucggccggaccaaguccaaccgccugcggaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccgccccugcuucugggucgagcuggugcgggggcucccgcgcgagaacacgaccaucuggaccagcggcuccagcaucuccuucugcggggucaacagcgacaccgccaacugguccuggcccgacggcgccgagcugcccuucacgaucgacaaguga

SEQ ID NO: 78913 - RNA, 1410 nt, Artificial Sequence
  derived and/or modified sequence opt1 from neuraminidase__InfluenzaA__ADA71161
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaaccucaugccgaucuga

SEQ ID NO: 78914 - RNA, 1413 nt, Artificial Sequence
  derived and/or modified sequence opt1 from neuraminidase__InfluenzaA__ADA71165
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucagcaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 78915 - RNA, 1410 nt, Artificial Sequence
  derived and/or modified sequence opt1 from neuraminidase__InfluenzaA__ADA71167
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggacauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucaaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccaacaucaaccugaugcccaucuga

SEQ ID NO: 78916 - RNA, 1413 nt, Artificial Sequence
  derived and/or modified sequence opt1 from neuraminidase__InfluenzaA__ADA71169
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaucaacgggagcugcuucaccaucaugacggacggccccuccgacggggccgccagcuacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucagcuucaaccagaaccuggacuaccagaucggcuacaucugcuccgggguguucggcgacaacccccgcccgaaggacggggagggcagcugcaaccccgugacggucgacggggccaacggcgugaagggcuucuccuacaaguacgggaacggcguguggaucgggcggaccaagagcaaccgcauccggaagggcuucgagaugaucugggaccccaacggguggaccaacaccgacuccgacuucagcgucaagcaggacaucguggcgaucacggacugguccggcuacagcggcagcuucgugcagcaccccgagcugaccgggcucgacugcauccgcccgugcuucugggucgagcuggugcggggccugccccgcgagaacaccaccaucuggacguccgggagcuccaucagcuucugcggcgucaacggcgacaucgccaacugguccuggcccgacggggccgagcuccccuucaccaucgacaaguga

SEQ ID NO: 78917 - RNA, 1413 nt, Artificial Sequence; identical to SEQ ID NO: 78469
  derived and/or modified sequence opt1 from neuraminidase__InfluenzaA__ADA71171

SEQ ID NO: 78918 - RNA, 1410 nt, Artificial Sequence
  derived and/or modified sequence opt1 from neuraminidase__InfluenzaA__ADA71173
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgcccggaccccguaccgcacccugcucaugaacgagcugggcgugcccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggcggacaccaagauccucuucaucgaggagggcaagaucgugcacacgagcacccuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucaaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 78919 - RNA, 1413 nt, Artificial Sequence
  derived and/or modified sequence opt1 from neuraminidase__InfluenzaA__ADA71175
augaaccccaaccagaagaucaucaccaucggcagcaucuccaucgccaucgggaucaucagccugaugcuccagaucggcaacaucaucuccaucugggccagccacuccauccagaucgggagccagaacaacaccggcaucugcaaccagcgcaucaucacguacgagaacuccaccugggugaaccacaccuacgucaacaucaacaacaccaaggugguggcgggggaggacaagacgagcgucacccuggccggcaacuccagccugugcuccaucagcggcugggccaucaacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 78920 - RNA, 1413 nt, Artificial Sequence; identical to SEQ ID NO: 78469
  derived and/or modified sequence opt1 from neuraminidase__InfluenzaA__ADA71177

SEQ ID NO: 78921 - RNA, 1410 nt, Artificial Sequence
  derived and/or modified sequence opt1 from neuraminidase__InfluenzaA__ADA71193
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78922 - RNA, 1410 nt, Artificial Sequence
  derived and/or modified sequence opt1 from neuraminidase__InfluenzaA__ADA79589
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaagagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78923 - RNA, 1410 nt, Artificial Sequence
  derived and/or modified sequence opt1 from neuraminidase__InfluenzaA__ADA79599
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78924 - RNA, 1410 nt, Artificial Sequence; identical to SEQ ID NO: 78923
  derived and/or modified sequence opt1 from neuraminidase__InfluenzaA__ADA79609

SEQ ID NO: 78925 - RNA, 1410 nt, Artificial Sequence
  derived and/or modified sequence opt1 from neuraminidase__InfluenzaA__ADA79619
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggccuccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggcgugguccgccagcgccugccacgacgggaucaacuggcucaccaucggcaucuccggccccgacaacggggccgucgcggugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 78926 - RNA, 1410 nt, Artificial Sequence; identical to SEQ ID NO: 77746
  derived and/or modified sequence opt1 from neuraminidase__InfluenzaA__ADA81211

SEQ ID NO: 78927 - RNA, 1410 nt, Artificial Sequence
  derived and/or modified sequence opt1 from neuraminidase__InfluenzaA__ADA83035
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugcuccaccuucuuccugacccagggcgcccuccugaacgacaagcacuccaacgggaccaucaaggaccgcagccccuaccggacgcugauguccugcccgaucggcgagguccccagccccuacaacagccgcuucgaguccguggccuggagcgcguccgccugccacgacgggaucaacuggcucaccaucggcaucagcggccccgacaacggggccguggccguccugaaguacaacggcaucaucaccgacaccaucaaguccuggcggaacaacauccugcgcacgcaggagagcgagugcgcgugcgugaacggguccugcuucaccgugaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 78928 - RNA, 1410 nt, Artificial Sequence
  derived and/or modified sequence opt1 from neuraminidase__InfluenzaA__ADA83037
augaaccccaaccagaagaucaucaccaucggcagcgugugcaugaccaucgggauggccaaccugauccuccagaucggcaacaucaucuccaucuggaucagccacuccauccagcuggggaaccaggaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 78929 - RNA, 1410 nt, Artificial Sequence; identical to SEQ ID NO: 77746
  derived and/or modified sequence opt1 from neuraminidase__InfluenzaA__ADA83588

SEQ ID NO: 78930 - RNA, 1410 nt, Artificial Sequence; identical to SEQ ID NO: 77746
  derived and/or modified sequence opt1 from neuraminidase__InfluenzaA__ADA83592

SEQ ID NO: 78931 - RNA, 1410 nt, Artificial Sequence; identical to SEQ ID NO: 77746
  derived and/or modified sequence opt1 from neuraminidase__InfluenzaA__ADA83596

SEQ ID NO: 78932 - RNA, 1410 nt, Artificial Sequence; identical to SEQ ID NO: 77746
  derived and/or modified sequence opt1 from neuraminidase__InfluenzaA__ADA83600

SEQ ID NO: 78933 - RNA, 1410 nt, Artificial Sequence; identical to SEQ ID NO: 77746
  derived and/or modified sequence opt1 from neuraminidase__InfluenzaA__ADA83604

SEQ ID NO: 78934 - RNA, 1410 nt, Artificial Sequence; identical to SEQ ID NO: 77746
  derived and/or modified sequence opt1 from neuraminidase__InfluenzaA__ADA83608

SEQ ID NO: 78935 - RNA, 1410 nt, Artificial Sequence; identical to SEQ ID NO: 77746
  derived and/or modified sequence opt1 from neuraminidase__InfluenzaA__ADA83612

SEQ ID NO: 78936 - RNA, 1410 nt, Artificial Sequence; identical to SEQ ID NO: 78100
  derived and/or modified sequence opt1 from neuraminidase__InfluenzaA__ADA83616

SEQ ID NO: 78937 - RNA, 1410 nt, Artificial Sequence; identical to SEQ ID NO: 77746
  derived and/or modified sequence opt1 from neuraminidase__InfluenzaA__ADA83624

SEQ ID NO: 78938 - RNA, 1410 nt, Artificial Sequence; identical to SEQ ID NO: 77746
  derived and/or modified sequence opt1 from neuraminidase__InfluenzaA__ADA83630

SEQ ID NO: 78939 - RNA, 1410 nt, Artificial Sequence; identical to SEQ ID NO: 77746
  derived and/or modified sequence opt1 from neuraminidase__InfluenzaA__ADA83634

SEQ ID NO: 78940 - RNA, 1410 nt, Artificial Sequence; identical to SEQ ID NO: 77746
  derived and/or modified sequence opt1 from neuraminidase__InfluenzaA__ADA83638

SEQ ID NO: 78941 - RNA, 1410 nt, Artificial Sequence; identical to SEQ ID NO: 77746
  derived and/or modified sequence opt1 from neuraminidase__InfluenzaA__ADA83642

SEQ ID NO: 78942 - RNA, 1410 nt, Artificial Sequence; identical to SEQ ID NO: 77746
  derived and/or modified sequence opt1 from neuraminidase__InfluenzaA__ADA83649

SEQ ID NO: 78943 - RNA, 1410 nt, Artificial Sequence; identical to SEQ ID NO: 77746
  derived and/or modified sequence opt1 from neuraminidase__InfluenzaA__ADA83653

SEQ ID NO: 78944 - RNA, 1410 nt, Artificial Sequence; identical to SEQ ID NO: 77746
  derived and/or modified sequence opt1 from neuraminidase__InfluenzaA__ADA83657

SEQ ID NO: 78945 - RNA, 1410 nt, Artificial Sequence; identical to SEQ ID NO: 77746
  derived and/or modified sequence opt1 from neuraminidase__InfluenzaA__ADA83661

SEQ ID NO: 78946 - RNA, 1410 nt, Artificial Sequence; identical to SEQ ID NO: 77746
  derived and/or modified sequence opt1 from neuraminidase__InfluenzaA__ADA83669

SEQ ID NO: 78947 - RNA, 1410 nt, Artificial Sequence; identical to SEQ ID NO: 77746
  derived and/or modified sequence opt1 from neuraminidase__InfluenzaA__ADA83673

SEQ ID NO: 78948 - RNA, 1410 nt, Artificial Sequence; identical to SEQ ID NO: 77746
  derived and/or modified sequence opt1 from neuraminidase__InfluenzaA__ADA83677

SEQ ID NO: 78949 - RNA, 1410 nt, Artificial Sequence; identical to SEQ ID NO: 77746
  derived and/or modified sequence opt1 from neuraminidase__InfluenzaA__ADA83681

SEQ ID NO: 78950 - RNA, 1410 nt, Artificial Sequence; identical to SEQ ID NO: 77746
  derived and/or modified sequence opt1 from neuraminidase__InfluenzaA__ADA83685

SEQ ID NO: 78951 - RNA, 1410 nt, Artificial Sequence; identical to SEQ ID NO: 77746
  derived and/or modified sequence opt1 from neuraminidase__InfluenzaA__ADA86069

SEQ ID NO: 78952 - RNA, 1410 nt, Artificial Sequence; identical to SEQ ID NO: 77746
  derived and/or modified sequence opt1 from neuraminidase__InfluenzaA__ADB27973

SEQ ID NO: 78953 - RNA, 1410 nt, Artificial Sequence; identical to SEQ ID NO: 77746
  derived and/or modified sequence opt1 from neuraminidase__InfluenzaA__ADB27983

SEQ ID NO: 78954 - RNA, 1410 nt, Artificial Sequence
  derived and/or modified sequence opt1 from neuraminidase__InfluenzaA__ADB66693
augaaccccaaccagaagaucaucaccaucggcagcgugugcaugaccaucgggauggccaaccugauccuccagaucggcaacaucaucuccaucuggaucauccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78955 - RNA, 1410 nt, Artificial Sequence; identical to SEQ ID NO: 77746
  derived and/or modified sequence opt1 from neuraminidase__InfluenzaA__ADB66695

SEQ ID NO: 78956 - RNA, 1410 nt, Artificial Sequence; identical to SEQ ID NO: 77746
  derived and/or modified sequence opt1 from neuraminidase__InfluenzaA__ADB66696

SEQ ID NO: 78957 - RNA, 1410 nt, Artificial Sequence
  derived and/or modified sequence opt1 from neuraminidase__InfluenzaA__ADB66697
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacgagcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccggaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucagcaucaagcaggacaucgugggcauccacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 78958 - RNA, 1410 nt, Artificial Sequence; identical to SEQ ID NO: 78921
  derived and/or modified sequence opt1 from neuraminidase__InfluenzaA__ADB81401

SEQ ID NO: 78959 - RNA, 1410 nt, Artificial Sequence; identical to SEQ ID NO: 78764
  derived and/or modified sequence opt1 from neuraminidase__InfluenzaA__ADB81421

SEQ ID NO: 78960 - RNA, 1410 nt, Artificial Sequence; identical to SEQ ID NO: 78100
  derived and/or modified sequence opt1 from neuraminidase__InfluenzaA__ADB81431

SEQ ID NO: 78961 - RNA, 1410 nt, Artificial Sequence; identical to SEQ ID NO: 77746
  derived and/or modified sequence opt1 from neuraminidase__InfluenzaA__ADB81441

SEQ ID NO: 78962 - RNA, 1410 nt, Artificial Sequence
  derived and/or modified sequence opt1 from neuraminidase__InfluenzaA__ADB81451
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 78963 - RNA, 1410 nt, Artificial Sequence; identical to SEQ ID NO: 78923
  derived and/or modified sequence opt1 from neuraminidase__InfluenzaA__ADB81461

SEQ ID NO: 78964 - RNA, 1410 nt, Artificial Sequence; identical to SEQ ID NO: 78923
  derived and/or modified sequence opt1 from neuraminidase__InfluenzaA__ADB82942

SEQ ID NO: 78965 - RNA, 1410 nt, Artificial Sequence; identical to SEQ ID NO: 77901
  derived and/or modified sequence opt1 from neuraminidase__InfluenzaA__ADB82945

SEQ ID NO: 78966 - RNA, 1410 nt, Artificial Sequence; identical to SEQ ID NO: 77746
  derived and/or modified sequence opt1 from neuraminidase__InfluenzaA__ADB89132

SEQ ID NO: 78967 - RNA, 1410 nt, Artificial Sequence; identical to SEQ ID NO: 78329
  derived and/or modified sequence opt1 from neuraminidase__InfluenzaA__ADB89142

SEQ ID NO: 78968 - RNA, 1410 nt, Artificial Sequence; identical to SEQ ID NO: 77746
  derived and/or modified sequence opt1 from neuraminidase__InfluenzaA__ADB89224

SEQ ID NO: 78969 - RNA, 1410 nt, Artificial Sequence
  derived and/or modified sequence opt1 from neuraminidase__InfluenzaA__ADB89234
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 78970 - RNA, 1410 nt, Artificial Sequence; identical to SEQ ID NO: 77736
  derived and/or modified sequence opt1 from neuraminidase__InfluenzaA__ADB89244

SEQ ID NO: 78971 - RNA, 1410 nt, Artificial Sequence; identical to SEQ ID NO: 77746
  derived and/or modified sequence opt1 from neuraminidase__InfluenzaA__ADB89264

SEQ ID NO: 78972 - RNA, 1410 nt, Artificial Sequence; identical to SEQ ID NO: 78716
  derived and/or modified sequence opt1 from neuraminidase__InfluenzaA__ADB89274

SEQ ID NO: 78973 - RNA, 1410 nt, Artificial Sequence; identical to SEQ ID NO: 77901
  derived and/or modified sequence opt1 from neuraminidase__InfluenzaA__ADB89284

SEQ ID NO: 78974 - RNA, 1410 nt, Artificial Sequence; identical to SEQ ID NO: 77746
  derived and/or modified sequence opt1 from neuraminidase__InfluenzaA__ADB89294

SEQ ID NO: 78975 - RNA, 1410 nt, Artificial Sequence; identical to SEQ ID NO: 77746
  derived and/or modified sequence opt1 from neuraminidase__InfluenzaA__ADB89304

SEQ ID NO: 78976 - RNA, 1410 nt, Artificial Sequence; identical to SEQ ID NO: 77746
  derived and/or modified sequence opt1 from neuraminidase__InfluenzaA__ADB89314

SEQ ID NO: 78977 - RNA, 1410 nt, Artificial Sequence; identical to SEQ ID NO: 77746
  derived and/or modified sequence opt1 from neuraminidase__InfluenzaA__ADB89324

SEQ ID NO: 78978 - RNA, 1410 nt, Artificial Sequence; identical to SEQ ID NO: 77746
  derived and/or modified sequence opt1 from neuraminidase__InfluenzaA__ADB89334

SEQ ID NO: 78979 - RNA, 1410 nt, Artificial Sequence; identical to SEQ ID NO: 77746
  derived and/or modified sequence opt1 from neuraminidase__InfluenzaA__ADB89344

SEQ ID NO: 78980 - RNA, 1410 nt, Artificial Sequence; identical to SEQ ID NO: 77746
  derived and/or modified sequence opt1 from neuraminidase__InfluenzaA__ADB89364

SEQ ID NO: 78981 - RNA, 1410 nt, Artificial Sequence; identical to SEQ ID NO: 77746
  derived and/or modified sequence opt1 from neuraminidase__InfluenzaA__ADB89374

SEQ ID NO: 78982 - RNA, 1410 nt, Artificial Sequence; identical to SEQ ID NO: 77746
  derived and/or modified sequence opt1 from neuraminidase__InfluenzaA__ADB89384

SEQ ID NO: 78983 - RNA, 1410 nt, Artificial Sequence; identical to SEQ ID NO: 77746
  derived and/or modified sequence opt1 from neuraminidase__InfluenzaA__ADB89394

SEQ ID NO: 78984 - RNA, 1410 nt, Artificial Sequence
  derived and/or modified sequence opt1 from neuraminidase__InfluenzaA__ADB89404
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacuccauccugcggacgcaggagagcgagugcgcgugcgugaacggguccugcuucaccgucaugaccgacggcccgagcaacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 78985 - RNA, 1410 nt, Artificial Sequence; identical to SEQ ID NO: 77746
  derived and/or modified sequence opt1 from neuraminidase__InfluenzaA__ADB89414

SEQ ID NO: 78986 - RNA, 1410 nt, Artificial Sequence; identical to SEQ ID NO: 77746
  derived and/or modified sequence opt1 from neuraminidase__InfluenzaA__ADB89424

SEQ ID NO: 78987 - RNA, 1410 nt, Artificial Sequence; identical to SEQ ID NO: 77746
  derived and/or modified sequence opt1 from neuraminidase__InfluenzaA__ADB89434

SEQ ID NO: 78988 - RNA, 1410 nt, Artificial Sequence; identical to SEQ ID NO: 77746
  derived and/or modified sequence opt1 from neuraminidase__InfluenzaA__ADB89444

SEQ ID NO: 78989 - RNA, 1410 nt, Artificial Sequence
  derived and/or modified sequence opt1 from neuraminidase__InfluenzaA__ADB89454
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 78990 - RNA, 1410 nt, Artificial Sequence; identical to SEQ ID NO: 77746
  derived and/or modified sequence opt1 from neuraminidase__InfluenzaA__ADB89464

SEQ ID NO: 78991 - RNA, 1410 nt, Artificial Sequence; identical to SEQ ID NO: 77746
  derived and/or modified sequence opt1 from neuraminidase__InfluenzaA__ADB89484

SEQ ID NO: 78992 - RNA, 1410 nt, Artificial Sequence; identical to SEQ ID NO: 77746
  derived and/or modified sequence opt1 from neuraminidase__InfluenzaA__ADB89494

SEQ ID NO: 78993 - RNA, 1410 nt, Artificial Sequence; identical to SEQ ID NO: 77736
  derived and/or modified sequence opt1 from neuraminidase__InfluenzaA__ADB89504

SEQ ID NO: 78994 - RNA, 1410 nt, Artificial Sequence; identical to SEQ ID NO: 77746
  derived and/or modified sequence opt1 from neuraminidase__InfluenzaA__ADB89514

SEQ ID NO: 78995 - RNA, 1410 nt, Artificial Sequence; identical to SEQ ID NO: 77746
  derived and/or modified sequence opt1 from neuraminidase__InfluenzaA__ADB89524

SEQ ID NO: 78996 - RNA, 1410 nt, Artificial Sequence
  derived and/or modified sequence opt1 from neuraminidase__InfluenzaA__ADB89544
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcucccugcuggagugccgcaccuucuuccucacccagggcgcccugcugaacgacaagcacagcaacgggaccaucaaggaccggucccccuaccgcacgcucaugagcugccccaucggcgaggucccgucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccucgacugcauccgcccgugcuucugggucgagcugauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 78997 - RNA, 1410 nt, Artificial Sequence; identical to SEQ ID NO: 77746
  derived and/or modified sequence opt1 from neuraminidase__InfluenzaA__ADB89564

SEQ ID NO: 78998 - RNA, 1410 nt, Artificial Sequence; identical to SEQ ID NO: 77746
  derived and/or modified sequence opt1 from neuraminidase__InfluenzaA__ADB89574

SEQ ID NO: 78999 - RNA, 1410 nt, Artificial Sequence; identical to SEQ ID NO: 77746
  derived and/or modified sequence opt1 from neuraminidase__InfluenzaA__ADB89594

SEQ ID NO: 79000 - RNA, 1410 nt, Artificial Sequence; identical to SEQ ID NO: 77746
  derived and/or modified sequence opt1 from neuraminidase__InfluenzaA__ADB89604

SEQ ID NO: 79001 - RNA, 1410 nt, Artificial Sequence
  derived and/or modified sequence opt1 from neuraminidase__InfluenzaA__ADB89614
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacgggaucuggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79002 - RNA, 1410 nt, Artificial Sequence; identical to SEQ ID NO: 77746
  derived and/or modified sequence opt1 from neuraminidase__InfluenzaA__ADB89624

SEQ ID NO: 79003 - RNA, 1410 nt, Artificial Sequence; identical to SEQ ID NO: 77746
  derived and/or modified sequence opt1 from neuraminidase__InfluenzaA__ADB89634

SEQ ID NO: 79004 - RNA, 1410 nt, Artificial Sequence; identical to SEQ ID NO: 77746
  derived and/or modified sequence opt1 from neuraminidase__InfluenzaA__ADB89644

SEQ ID NO: 79005 - RNA, 1410 nt, Artificial Sequence; identical to SEQ ID NO: 78764
  derived and/or modified sequence opt1 from neuraminidase__InfluenzaA__ADB89664

SEQ ID NO: 79006 - RNA, 1410 nt, Artificial Sequence; identical to SEQ ID NO: 77746
  derived and/or modified sequence opt1 from neuraminidase__InfluenzaA__ADB89674

SEQ ID NO: 79007 - RNA, 1410 nt, Artificial Sequence; identical to SEQ ID NO: 77746
  derived and/or modified sequence opt1 from neuraminidase__InfluenzaA__ADB89684

SEQ ID NO: 79008 - RNA, 1410 nt, Artificial Sequence
  derived and/or modified sequence opt1 from neuraminidase__InfluenzaA__ADB89694
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucacgaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 79009 - RNA, 1410 nt, Artificial Sequence; identical to SEQ ID NO: 77746
  derived and/or modified sequence opt1 from neuraminidase__InfluenzaA__ADB89704

SEQ ID NO: 79010 - RNA, 1410 nt, Artificial Sequence; identical to SEQ ID NO: 77746
  derived and/or modified sequence opt1 from neuraminidase__InfluenzaA__ADB89714

SEQ ID NO: 79011 - RNA, 1410 nt, Artificial Sequence; identical to SEQ ID NO: 77607
  derived and/or modified sequence opt1 from neuraminidase__InfluenzaA__ADB89724

SEQ ID NO: 79012 - RNA, 1410 nt, Artificial Sequence; identical to SEQ ID NO: 77607
  derived and/or modified sequence opt1 from neuraminidase__InfluenzaA__ADB89735

SEQ ID NO: 79013 - RNA, 1410 nt, Artificial Sequence; identical to SEQ ID NO: 77746
  derived and/or modified sequence opt1 from neuraminidase__InfluenzaA__ADB90357

SEQ ID NO: 79014 - RNA, 1410 nt, Artificial Sequence; identical to SEQ ID NO: 77746
  derived and/or modified sequence opt1 from neuraminidase__InfluenzaA__ADB90358

SEQ ID NO: 79015 - RNA, 1410 nt, Artificial Sequence
  derived and/or modified sequence opt1 from neuraminidase__InfluenzaA__ADB90359
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccggaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggacgaacgagugguccggcuacagcggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccaucgacaaguga

SEQ ID NO: 79016 - RNA, 1410 nt, Artificial Sequence; identical to SEQ ID NO: 77746
  derived and/or modified sequence opt1 from neuraminidase__InfluenzaA__ADB90363

SEQ ID NO: 79017 - RNA, 1410 nt, Artificial Sequence; identical to SEQ ID NO: 78923
  derived and/or modified sequence opt1 from neuraminidase__InfluenzaA__ADB90373

SEQ ID NO: 79018 - RNA, 1410 nt, Artificial Sequence; identical to SEQ ID NO: 77746
  derived and/or modified sequence opt1 from neuraminidase__InfluenzaA__ADB98137

SEQ ID NO: 79019 - RNA, 1410 nt, Artificial Sequence; identical to SEQ ID NO: 78100
  derived and/or modified sequence opt1 from neuraminidase__InfluenzaA__ADB98138

SEQ ID NO: 79020 - RNA, 1410 nt, Artificial Sequence; identical to SEQ ID NO: 77746
  derived and/or modified sequence opt1 from neuraminidase__InfluenzaA__ADB98139

SEQ ID NO: 79021 - RNA, 1410 nt, Artificial Sequence; identical to SEQ ID NO: 78100
  derived and/or modified sequence opt1 from neuraminidase__InfluenzaA__ADB98140

SEQ ID NO: 79022 - RNA, 1410 nt, Artificial Sequence; identical to SEQ ID NO: 78100
  derived and/or modified sequence opt1 from neuraminidase__InfluenzaA__ADB98141

SEQ ID NO: 79023 - RNA, 1410 nt, Artificial Sequence; identical to SEQ ID NO: 77746
  derived and/or modified sequence opt1 from neuraminidase__InfluenzaA__ADC32391

SEQ ID NO: 79024 - RNA, 1410 nt, Artificial Sequence; identical to SEQ ID NO: 77746
  derived and/or modified sequence opt1 from neuraminidase__InfluenzaA__ADC32392

SEQ ID NO: 79025 - RNA, 1410 nt, Artificial Sequence; identical to SEQ ID NO: 77746
  derived and/or modified sequence opt1 from neuraminidase__InfluenzaA__ADC32393

SEQ ID NO: 79026 - RNA, 1410 nt, Artificial Sequence; identical to SEQ ID NO: 77746
  derived and/or modified sequence opt1 from neuraminidase__InfluenzaA__ADC32394

SEQ ID NO: 79027 - RNA, 1410 nt, Artificial Sequence; identical to SEQ ID NO: 77746
  derived and/or modified sequence opt1 from neuraminidase__InfluenzaA__ADC32395

SEQ ID NO: 79028 - RNA, 1410 nt, Artificial Sequence; identical to SEQ ID NO: 77746
  derived and/or modified sequence opt1 from neuraminidase__InfluenzaA__ADC32396

SEQ ID NO: 79029 - RNA, 1410 nt, Artificial Sequence; identical to SEQ ID NO: 77746
  derived and/or modified sequence opt1 from neuraminidase__InfluenzaA__ADC32397

SEQ ID NO: 79030 - RNA, 1410 nt, Artificial Sequence; identical to SEQ ID NO: 77746
  derived and/or modified sequence opt1 from neuraminidase__InfluenzaA__ADC32398

SEQ ID NO: 79031 - RNA, 1410 nt, Artificial Sequence; identical to SEQ ID NO: 77746
  derived and/or modified sequence opt1 from neuraminidase__InfluenzaA__ADC32399

SEQ ID NO: 79032 - RNA, 1410 nt, Artificial Sequence; identical to SEQ ID NO: 77746
  derived and/or modified sequence opt1 from neuraminidase__InfluenzaA__ADC32400

SEQ ID NO: 79033 - RNA, 1410 nt, Artificial Sequence; identical to SEQ ID NO: 77746
  derived and/or modified sequence opt1 from neuraminidase__InfluenzaA__ADC32401

SEQ ID NO: 79034 - RNA, 1410 nt, Artificial Sequence
  derived and/or modified sequence opt1 from neuraminidase__InfluenzaA__ADC32404
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79035 - RNA, 1410 nt, Artificial Sequence
  derived and/or modified sequence opt1 from neuraminidase__InfluenzaA__ADC32407
augaaccccaagcagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79036 - RNA, 1410 nt, Artificial Sequence
  derived and/or modified sequence opt1 from neuraminidase__InfluenzaA__ADC34942
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccgggagugguccaagccccagugcaacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacgacaucguccgcgaccggacccccuaccgcacccugcucaugaacgagcugggcgugcccuuccaccugggcaccaagcaggucugcaucgccugguccagcuccagcugccacgacgggaaggccuggcuccacgugugcgugacgggcgacgacaagaacgcgaccgccuccuucaucuacaacgggcggcugguggacagcaucgucuccuggagcaaggagauccugcgcacccaggaguccgagugcgugugcaucaacgggaccugcacgguggucaugaccgacggcagcgccuccggcaaggccgacaccaagauccucuucaucgaggagggcaagaucgugcacaccagcacgcugagcggguccgcgcagcacguggaggagugcagcugcuacccccgguacccgggcguccgcugcgugugccgggacaacuggcgcggguccaaccggcccaucguggacaucaacaugaaggacuacagcaucgucuccagcuacgugugcuccggccuggugggcgacacgccccgcaagaacgacagcuccagcuccgggcacugccucaaccccaacaacgaggagggcgggcacggcgucaaggggugggccuucgacgacggcaacgacguguggaugggccggaccaucagcgagaagcugcgcuccggguacgagaccuucaaggucaucgagggcuggagcaacccgaacuccaagcugcagaucaaccgccaggugaucguggaccgggggaaccggagcggcuacuccgggaucuucagcgucgagggcaaguccugcaucaaccgcugcuucuacguggagcucauccggggccgcaaggaggagaccgaggugcuguggaccagcaacagcaucgucguguucugcgggaccuccggcaccuacgggacgggcagcuggcccgacggggccgacaucaaccugaugcccaucuga

SEQ ID NO: 79037 - RNA, 1410 nt, Artificial Sequence
  derived and/or modified sequence opt1 from neuraminidase__InfluenzaA__ADC39000
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaacgucgggugguccuggcccgacggcgccgagcugccguucaccaucgacaaguga

SEQ ID NO: 79038 - RNA, 1410 nt, Artificial Sequence; identical to SEQ ID NO: 77746
  derived and/or modified sequence opt1 from neuraminidase__InfluenzaA__ADC39010

SEQ ID NO: 79039 - RNA, 1413 nt, Artificial Sequence; identical to SEQ ID NO: 77640
  derived and/or modified sequence opt1 from neuraminidase__InfluenzaA__ADC45606

SEQ ID NO: 79040 - RNA, 1413 nt, Artificial Sequence
  derived and/or modified sequence opt1 from neuraminidase__InfluenzaA__ADC45628
augaaccccaaccagaagaucaucaccaucggcagcaucuccaucgccaucgggaucaucagccugaugcuccagaugggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucagcuucaaccagaaccuggacuaccagaucggcuacaucugcuccgggguguucggcgacaacccccgcccgaaggaccgggaggggagcugcaaccccgugacggucgacggcgccaacggggugaagggcuucuccuacaaguacggcaacgggguguggaucggccgcaccaagagcaaccggauccgcaagggguucgagaugaucugggaccccaacggcuggaccaacaccgacuccgacuucagcgucaagcaggacaucguggcgaucacggacugguccggguacagcggcagcuucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 79041 - RNA, 1413 nt, Artificial Sequence
  derived and/or modified sequence opt1 from neuraminidase__InfluenzaA__ADC45639
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucggggucuccggccccgacaacggggccguggcggugcugaaguacaagggcaucaucacgggcaccaucaagagcuggaagaagcagauccugcggacccaggaguccgagugcgucugcaugaacgggagcugcuucaccaucaugacggacggccccuccaacggggccgccagcuacaagaucuucaagaucgagaagggcaaggugaccaaguccauggagcucaacgccccgaacuuccacuacgaggagugcagcugcuaccccgacaccgggaccgugaugugcgucugccgcgacaacuggcacggcuccaaccggcccugggugagcuucaaccagaaccuggacuaccagaucggcuacaucugcuccgggguguucggcgacaacccccgcccgaaggaccgggaggggagcugcaaccccgucacgguggacggcgccaacggggugaagggcuucuccuacaaguacggcaacggggucuggaucggccgcaccaagagcaaccggauccgcaagggguucgagaugaucugggaccccaacggcuggaccaacaccgacuccgacuucagcgugaagcaggacaucguggcgaucacggacugguccggguacagcggcagcuucguccagcaccccgagcugaccggccucgacugcauccggccgugcuucuggguggagcugguccgcgggcugccccgggagaacaccaccaucuggacguccggcagcuccaucagcuucugcggggugaacggcgacaucgccaacugguccuggcccgacggcgccgagcuccccuucaccaucgacaaguga

SEQ ID NO: 79042 - RNA, 1413 nt, Artificial Sequence; identical to SEQ ID NO: 77640
  derived and/or modified sequence opt1 from neuraminidase__InfluenzaA__ADC45650

SEQ ID NO: 79043 - RNA, 1413 nt, Artificial Sequence; identical to SEQ ID NO: 77640
  derived and/or modified sequence opt1 from neuraminidase__InfluenzaA__ADC45661

SEQ ID NO: 79044 - RNA, 1413 nt, Artificial Sequence
  derived and/or modified sequence opt1 from neuraminidase__InfluenzaA__ADC45683
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcgggggaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucagcuucaaccagaaccuggacuaccagaucggcuacaucugcuccgggguguucggcgacaacccccgcccgaaggaccgggaggggagcugcaaccccgugacggucgacggcgccaacggggugaagggcuucuccuacaaguacggcaacgggguguggaucggccgcaccaagagcaaccggauccgcaagggguucgagaugaucugggaccccaacggcuggaccaacaccgacuccgacuucagcgucaagcaggacaucguggcgaucacggacugguccggguacagcggcagcuucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 79045 - RNA, 1413 nt, Artificial Sequence
  derived and/or modified sequence opt1 from neuraminidase__InfluenzaA__ADC45705
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaagaaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 79046 - RNA, 1413 nt, Artificial Sequence
  derived and/or modified sequence opt1 from neuraminidase__InfluenzaA__ADC45716
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucagcuucaaccagaaccuggacuaccagaucggcuacaucugcuccgggguguucggcgacaacccccgcccgaaggaccgggaggggagcugcaaccccgugacggucgacggcgccaacgggguggagggcuucuccuacaaguacggcaacgggguguggaucggccgcaccaagagcaaccggauccgcaagggguucgagaugaucugggaccccaacggcuggaccaacaccgacuccgacuucagcgucaagcaggacaucguggcgaucacgaacugguccggguacagcggcagcuucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 79047 - RNA, 1413 nt, Artificial Sequence
  derived and/or modified sequence opt1 from neuraminidase__InfluenzaA__ADC45738
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 79048 - RNA, 1413 nt, Artificial Sequence
  derived and/or modified sequence opt1 from neuraminidase__InfluenzaA__ADC45760
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgccaaggaccgcagccccuaccgggcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccguggacggcgccaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggggugcauccggcccugcuucuggguggagcugguccgcggccucccgcgggagaacaccaccaucuggaccagcggguccagcaucuccuucugcggcgugaacagcgacacggccaacugguccuggcccgacggcgccgagcugcccuucaccaucgacaaguga

SEQ ID NO: 79049 - RNA, 1413 nt, Artificial Sequence
  derived and/or modified sequence opt1 from neuraminidase__InfluenzaA__ADC45771
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccaugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 79050 - RNA, 1413 nt, Artificial Sequence
  derived and/or modified sequence opt1 from neuraminidase__InfluenzaA__ADC45782
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaaccgcaccgucaaggaccggagccccuaccgcgcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcggacccaggagagcgagugcgugugcgugaacggcuccugcuucaccaucaugacggacgggcccagcaacaaggccgccuccuacaagaucuucaagaucgagaagggcaaggucaccaagagcaucgagcucaacgcccccaacuucuacuacgaggagugcuccugcuacccggacaccgggaucgugaugugcgugugccgcgacaacuggcacggcagcaaccggcccugggucuccuucaaccagaaccuggacuaccagaucggguacaucugcagcggcguguucggcgacaacccccgccccgaggacggggagggcuccugcaacccggugaccgucgacggggcgaacggcgugaagggguucagcuacaaguacggcaacggcguguggaucgggcggacgaaguccaaccgccugcggaagggcuucgagaugaucugggaccccaacggguggaccaacaccgacagcgacuucuccgucaagcaggacgugguggccaucaccgacuggagcggcuacagcggguccuucguccagcaccccgagcucacgggccuggacugcauccgccccugcuucuggguggagcugguccggggccucccgcgcgagaacaccaccaucuggaccagcggguccagcaucuccuucugcggcgugaacagcgacacggccaacugguccuggcccgacggggccgagcugcccuucaccaucgacaaguga

SEQ ID NO: 79051 - RNA, 1413 nt, Artificial Sequence
  derived and/or modified sequence opt1 from neuraminidase__InfluenzaA__ADC45804
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaagaucaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 79052 - RNA, 1413 nt, Artificial Sequence
  derived and/or modified sequence opt1 from neuraminidase__InfluenzaA__ADC45815
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccgugaaguccuggaagaagcagauccugcgcacccaggagagcgagugcgugugcaugaacggguccugcuucaccaucaugacggacggccccagcaacaaggccgccuccuacaagaucuucaagaucgagaaggggaaggucaccaagagcaucgagcucaacgcccccaacuucuacuacgaggagugcuccugcuacccggacaccggcauggugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccaacaccgacagcgacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 79053 - RNA, 1413 nt, Artificial Sequence; identical to SEQ ID NO: 78469
  derived and/or modified sequence opt1 from neuraminidase__InfluenzaA__ADC45837

SEQ ID NO: 79054 - RNA, 1413 nt, Artificial Sequence; identical to SEQ ID NO: 78469
  derived and/or modified sequence opt1 from neuraminidase__InfluenzaA__ADC45848

SEQ ID NO: 79055 - RNA, 1410 nt, Artificial Sequence; identical to SEQ ID NO: 77746
  derived and/or modified sequence opt1 from neuraminidase__InfluenzaA__ADC53559

SEQ ID NO: 79056 - RNA, 1410 nt, Artificial Sequence; identical to SEQ ID NO: 77746
  derived and/or modified sequence opt1 from neuraminidase__InfluenzaA__ADD14088

SEQ ID NO: 79057 - RNA, 1410 nt, Artificial Sequence; identical to SEQ ID NO: 77746
  derived and/or modified sequence opt1 from neuraminidase__InfluenzaA__ADD14090

SEQ ID NO: 79058 - RNA, 1410 nt, Artificial Sequence; identical to SEQ ID NO: 77746
  derived and/or modified sequence opt1 from neuraminidase__InfluenzaA__ADD14094

SEQ ID NO: 79059 - RNA, 1410 nt, Artificial Sequence; identical to SEQ ID NO: 77746
  derived and/or modified sequence opt1 from neuraminidase__InfluenzaA__ADD14096

SEQ ID NO: 79060 - RNA, 1410 nt, Artificial Sequence; identical to SEQ ID NO: 77746
  derived and/or modified sequence opt1 from neuraminidase__InfluenzaA__ADD14098

SEQ ID NO: 79061 - RNA, 1410 nt, Artificial Sequence; identical to SEQ ID NO: 77746
  derived and/or modified sequence opt1 from neuraminidase__InfluenzaA__ADD14100

SEQ ID NO: 79062 - RNA, 1410 nt, Artificial Sequence; identical to SEQ ID NO: 77746
  derived and/or modified sequence opt1 from neuraminidase__InfluenzaA__ADD14102

SEQ ID NO: 79063 - RNA, 1410 nt, Artificial Sequence; identical to SEQ ID NO: 77746
  derived and/or modified sequence opt1 from neuraminidase__InfluenzaA__ADD14104

SEQ ID NO: 79064 - RNA, 1410 nt, Artificial Sequence; identical to SEQ ID NO: 77746
  derived and/or modified sequence opt1 from neuraminidase__InfluenzaA__ADD14106

SEQ ID NO: 79065 - RNA, 1410 nt, Artificial Sequence; identical to SEQ ID NO: 77746
  derived and/or modified sequence opt1 from neuraminidase__InfluenzaA__ADD14110

SEQ ID NO: 79066 - RNA, 1410 nt, Artificial Sequence; identical to SEQ ID NO: 77746
  derived and/or modified sequence opt1 from neuraminidase__InfluenzaA__ADD14112

SEQ ID NO: 79067 - RNA, 1410 nt, Artificial Sequence; identical to SEQ ID NO: 78716
  derived and/or modified sequence opt1 from neuraminidase__InfluenzaA__ADD14114

SEQ ID NO: 79068 - RNA, 1410 nt, Artificial Sequence; identical to SEQ ID NO: 77746
  derived and/or modified sequence opt1 from neuraminidase__InfluenzaA__ADD14116

SEQ ID NO: 79069 - RNA, 1410 nt, Artificial Sequence; identical to SEQ ID NO: 77746
  derived and/or modified sequence opt1 from neuraminidase__InfluenzaA__ADD14118

SEQ ID NO: 79070 - RNA, 1410 nt, Artificial Sequence; identical to SEQ ID NO: 77746
  derived and/or modified sequence opt1 from neuraminidase__InfluenzaA__ADD14120

SEQ ID NO: 79071 - RNA, 1410 nt, Artificial Sequence; identical to SEQ ID NO: 77746
  derived and/or modified sequence opt1 from neuraminidase__InfluenzaA__ADD14122

SEQ ID NO: 79072 - RNA, 1410 nt, Artificial Sequence; identical to SEQ ID NO: 77746
  derived and/or modified sequence opt1 from neuraminidase__InfluenzaA__ADD14124

SEQ ID NO: 79073 - RNA, 1410 nt, Artificial Sequence; identical to SEQ ID NO: 78805
  derived and/or modified sequence opt1 from neuraminidase__InfluenzaA__ADD14126

SEQ ID NO: 79074 - RNA, 1410 nt, Artificial Sequence; identical to SEQ ID NO: 77746
  derived and/or modified sequence opt1 from neuraminidase__InfluenzaA__ADD14128

SEQ ID NO: 79075 - RNA, 1410 nt, Artificial Sequence; identical to SEQ ID NO: 77746
  derived and/or modified sequence opt1 from neuraminidase__InfluenzaA__ADD14130

SEQ ID NO: 79076 - RNA, 1410 nt, Artificial Sequence; identical to SEQ ID NO: 77746
  derived and/or modified sequence opt1 from neuraminidase__InfluenzaA__ADD14132

SEQ ID NO: 79077 - RNA, 1410 nt, Artificial Sequence; identical to SEQ ID NO: 77746
  derived and/or modified sequence opt1 from neuraminidase__InfluenzaA__ADD14134

SEQ ID NO: 79078 - RNA, 1410 nt, Artificial Sequence; identical to SEQ ID NO: 77746
  derived and/or modified sequence opt1 from neuraminidase__InfluenzaA__ADD14136

SEQ ID NO: 79079 - RNA, 1410 nt, Artificial Sequence; identical to SEQ ID NO: 77746
  derived and/or modified sequence opt1 from neuraminidase__InfluenzaA__ADD14138

SEQ ID NO: 79080 - RNA, 1410 nt, Artificial Sequence; identical to SEQ ID NO: 77746
  derived and/or modified sequence opt1 from neuraminidase__InfluenzaA__ADD14142

SEQ ID NO: 79081 - RNA, 1410 nt, Artificial Sequence; identical to SEQ ID NO: 77746
  derived and/or modified sequence opt1 from neuraminidase__InfluenzaA__ADD14144

SEQ ID NO: 79082 - RNA, 1410 nt, Artificial Sequence; identical to SEQ ID NO: 77746
  derived and/or modified sequence opt1 from neuraminidase__InfluenzaA__ADD14146

SEQ ID NO: 79083 - RNA, 1410 nt, Artificial Sequence; identical to SEQ ID NO: 77746
  derived and/or modified sequence opt1 from neuraminidase__InfluenzaA__ADD14148

SEQ ID NO: 79084 - RNA, 1410 nt, Artificial Sequence
  derived and/or modified sequence opt1 from neuraminidase__InfluenzaA__ADD14150
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacgacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79085 - RNA, 1410 nt, Artificial Sequence; identical to SEQ ID NO: 77746
  derived and/or modified sequence opt1 from neuraminidase__InfluenzaA__ADD14152

SEQ ID NO: 79086 - RNA, 1410 nt, Artificial Sequence
  derived and/or modified sequence opt1 from neuraminidase__InfluenzaA__ADD14154
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaucacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79087 - RNA, 1410 nt, Artificial Sequence; identical to SEQ ID NO: 77746
  derived and/or modified sequence opt1 from neuraminidase__InfluenzaA__ADD14156

SEQ ID NO: 79088 - RNA, 1410 nt, Artificial Sequence; identical to SEQ ID NO: 77746
  derived and/or modified sequence opt1 from neuraminidase__InfluenzaA__ADD14158

SEQ ID NO: 79089 - RNA, 1410 nt, Artificial Sequence; identical to SEQ ID NO: 77746
  derived and/or modified sequence opt1 from neuraminidase__InfluenzaA__ADD14164

SEQ ID NO: 79090 - RNA, 1410 nt, Artificial Sequence; identical to SEQ ID NO: 77746
  derived and/or modified sequence opt1 from neuraminidase__InfluenzaA__ADD14174

SEQ ID NO: 79091 - RNA, 1410 nt, Artificial Sequence; identical to SEQ ID NO: 77746
  derived and/or modified sequence opt1 from neuraminidase__InfluenzaA__ADD14184

SEQ ID NO: 79092 - RNA, 1410 nt, Artificial Sequence; identical to SEQ ID NO: 77746
  derived and/or modified sequence opt1 from neuraminidase__InfluenzaA__ADD14194

SEQ ID NO: 79093 - RNA, 1410 nt, Artificial Sequence; identical to SEQ ID NO: 78100
  derived and/or modified sequence opt1 from neuraminidase__InfluenzaA__ADD14204

SEQ ID NO: 79094 - RNA, 1410 nt, Artificial Sequence
  derived and/or modified sequence opt1 from neuraminidase__InfluenzaA__ADD21449
augaaccccaaccagcgcaucaucaccaucggcaccgccugccugaucaucgggaucgugagccuccugcugcagaucggcaacaucgucucccucuggaucagccacuccauccagacgggggagaagaaccacagcgagaccugcaaccggaacaccaucaccuacgagaacuccacgugggugaaccagaccuacgugaacaucagcaacaucaacaucgccggcgggcagggcgucgcguccaucauccuggccggcaacagcucccugugcccggugaacgggugggccaucuacagcaaggacaacuccauccgcaucggcagcaagggggacaucuucgugauccgggagcccuucaucuccugcagccaccucgagugccgcaccuucuuccugacccagggcgcccugcucaacgaccggcacuccaacgggacggucaaggaccgcagccccuaccggacccugauguccugccccaucggcgaggccccgagccccuacaacuccaaguucgagagcguggcguggagcgccuccgccugccacgacggcaugggguggcugaccaucggcaucagcgggcccgacaacggcgccguggcgguccucaaguacaacggcaucaucaccgacacgaucaaguccuggcgcaaccggauccugcgcacccaggagagcgagugcgugugcaucaacggguccugcuucaccaucaugaccgacggccccagcaacgggcaggccuccuacaagaucuucaagauggagcggggcaagaucaucaagagcguggagcuggacgccccgaacuaccacuacgaggagugcuccugcuaccccgacacggggaaggucgugugcgugugccgcgacaacuggcacgccagcaaccggcccugggucuccuucgaccagaaccucgacuaccagaucggcuacaucagcuccggcguguucggggacaacccccgcagcaacgacggcaaggggaacugcggcccggugcuguccaacggggccaacggcgucaagggccugagcuuccgguacgggaacggcguguggaucgggcgcaccaaguccaccaacagccgguccggcuucgagaugaucugggaccccaacggguggaccgagacggacagcaacuucagcaugaagcaggacaucaucgcgcucaccgacugguccggcuacagcggcuccuucgugcagcaccccgagcugaccgggaugaacugcauccgccccugcuucugggucgagcugauccggggccagccgaagcagagcaccaucuggacguccgggagcuccaucagcuucugcggcguggacuccgagaccgccagcugguccuggcccgacggcgccgaccuccccuucaccaucgacaaguga

SEQ ID NO: 79095 - RNA, 1413 nt, Artificial Sequence
  derived and/or modified sequence opt1 from neuraminidase__InfluenzaA__ADD21469
augaaccccaaccagaagaucaucaccaucggcagcaucuccaucgccaucgggaucaucagccugaugcuccagaucggcaacaucaucuccgugugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcaugcugcggacccaggagagcgagugcaucugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 79096 - RNA, 1410 nt, Artificial Sequence; identical to SEQ ID NO: 77746
  derived and/or modified sequence opt1 from neuraminidase__InfluenzaA__ADD21747

SEQ ID NO: 79097 - RNA, 1410 nt, Artificial Sequence
  derived and/or modified sequence opt1 from neuraminidase__InfluenzaA__ADD21767
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79098 - RNA, 1410 nt, Artificial Sequence
  derived and/or modified sequence opt1 from neuraminidase__InfluenzaA__ADD21777
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccgucaucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 79099 - RNA, 1410 nt, Artificial Sequence; identical to SEQ ID NO: 77746
  derived and/or modified sequence opt1 from neuraminidase__InfluenzaA__ADD21787

SEQ ID NO: 79100 - RNA, 1410 nt, Artificial Sequence; identical to SEQ ID NO: 77746
  derived and/or modified sequence opt1 from neuraminidase__InfluenzaA__ADD21797

SEQ ID NO: 79101 - RNA, 1410 nt, Artificial Sequence; identical to SEQ ID NO: 77746
  derived and/or modified sequence opt1 from neuraminidase__InfluenzaA__ADD21817

SEQ ID NO: 79102 - RNA, 1410 nt, Artificial Sequence; identical to SEQ ID NO: 77746
  derived and/or modified sequence opt1 from neuraminidase__InfluenzaA__ADD21827

SEQ ID NO: 79103 - RNA, 1410 nt, Artificial Sequence; identical to SEQ ID NO: 77746
  derived and/or modified sequence opt1 from neuraminidase__InfluenzaA__ADD21837

SEQ ID NO: 79104 - RNA, 1410 nt, Artificial Sequence; identical to SEQ ID NO: 77746
  derived and/or modified sequence opt1 from neuraminidase__InfluenzaA__ADD21847

SEQ ID NO: 79105 - RNA, 1410 nt, Artificial Sequence; identical to SEQ ID NO: 77746
  derived and/or modified sequence opt1 from neuraminidase__InfluenzaA__ADD21857

SEQ ID NO: 79106 - RNA, 1410 nt, Artificial Sequence; identical to SEQ ID NO: 77746
  derived and/or modified sequence opt1 from neuraminidase__InfluenzaA__ADD21867

SEQ ID NO: 79107 - RNA, 1410 nt, Artificial Sequence; identical to SEQ ID NO: 77746
  derived and/or modified sequence opt1 from neuraminidase__InfluenzaA__ADD21877

SEQ ID NO: 79108 - RNA, 1410 nt, Artificial Sequence; identical to SEQ ID NO: 77746
  derived and/or modified sequence opt1 from neuraminidase__InfluenzaA__ADD21897

SEQ ID NO: 79109 - RNA, 1410 nt, Artificial Sequence; identical to SEQ ID NO: 77746
  derived and/or modified sequence opt1 from neuraminidase__InfluenzaA__ADD22494

SEQ ID NO: 79110 - RNA, 1410 nt, Artificial Sequence; identical to SEQ ID NO: 77746
  derived and/or modified sequence opt1 from neuraminidase__InfluenzaA__ADD22504

SEQ ID NO: 79111 - RNA, 1410 nt, Artificial Sequence; identical to SEQ ID NO: 77746
  derived and/or modified sequence opt1 from neuraminidase__InfluenzaA__ADD22514

SEQ ID NO: 79112 - RNA, 1410 nt, Artificial Sequence; identical to SEQ ID NO: 77746
  derived and/or modified sequence opt1 from neuraminidase__InfluenzaA__ADD22524

SEQ ID NO: 79113 - RNA, 1410 nt, Artificial Sequence
  derived and/or modified sequence opt1 from neuraminidase__InfluenzaA__ADD22534
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacagcccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79114 - RNA, 1410 nt, Artificial Sequence; identical to SEQ ID NO: 77746
  derived and/or modified sequence opt1 from neuraminidase__InfluenzaA__ADD22544

SEQ ID NO: 79115 - RNA, 1410 nt, Artificial Sequence; identical to SEQ ID NO: 77746
  derived and/or modified sequence opt1 from neuraminidase__InfluenzaA__ADD22557

SEQ ID NO: 79116 - RNA, 1410 nt, Artificial Sequence; identical to SEQ ID NO: 77746
  derived and/or modified sequence opt1 from neuraminidase__InfluenzaA__ADD22567

SEQ ID NO: 79117 - RNA, 1410 nt, Artificial Sequence; identical to SEQ ID NO: 77746
  derived and/or modified sequence opt1 from neuraminidase__InfluenzaA__ADD22577

SEQ ID NO: 79118 - RNA, 1410 nt, Artificial Sequence; identical to SEQ ID NO: 77746
  derived and/or modified sequence opt1 from neuraminidase__InfluenzaA__ADD22587

SEQ ID NO: 79119 - RNA, 1410 nt, Artificial Sequence; identical to SEQ ID NO: 77746
  derived and/or modified sequence opt1 from neuraminidase__InfluenzaA__ADD22597

SEQ ID NO: 79120 - RNA, 1410 nt, Artificial Sequence; identical to SEQ ID NO: 77746
  derived and/or modified sequence opt1 from neuraminidase__InfluenzaA__ADD22617

SEQ ID NO: 79121 - RNA, 1410 nt, Artificial Sequence; identical to SEQ ID NO: 77746
  derived and/or modified sequence opt1 from neuraminidase__InfluenzaA__ADD22627

SEQ ID NO: 79122 - RNA, 1410 nt, Artificial Sequence; identical to SEQ ID NO: 77746
  derived and/or modified sequence opt1 from neuraminidase__InfluenzaA__ADD22637

SEQ ID NO: 79123 - RNA, 1410 nt, Artificial Sequence; identical to SEQ ID NO: 77746
  derived and/or modified sequence opt1 from neuraminidase__InfluenzaA__ADD22648

SEQ ID NO: 79124 - RNA, 1410 nt, Artificial Sequence; identical to SEQ ID NO: 77746
  derived and/or modified sequence opt1 from neuraminidase__InfluenzaA__ADD22658

SEQ ID NO: 79125 - RNA, 1410 nt, Artificial Sequence; identical to SEQ ID NO: 77746
  derived and/or modified sequence opt1 from neuraminidase__InfluenzaA__ADD22668

SEQ ID NO: 79126 - RNA, 1410 nt, Artificial Sequence
  derived and/or modified sequence opt1 from neuraminidase__InfluenzaA__ADD22688
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucuggaucgagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79127 - RNA, 1410 nt, Artificial Sequence; identical to SEQ ID NO: 77746
  derived and/or modified sequence opt1 from neuraminidase__InfluenzaA__ADD22698

SEQ ID NO: 79128 - RNA, 1410 nt, Artificial Sequence; identical to SEQ ID NO: 77746
  derived and/or modified sequence opt1 from neuraminidase__InfluenzaA__ADD22725

SEQ ID NO: 79129 - RNA, 1410 nt, Artificial Sequence; identical to SEQ ID NO: 77746
  derived and/or modified sequence opt1 from neuraminidase__InfluenzaA__ADD22735

SEQ ID NO: 79130 - RNA, 1410 nt, Artificial Sequence; identical to SEQ ID NO: 77746
  derived and/or modified sequence opt1 from neuraminidase__InfluenzaA__ADD22745

SEQ ID NO: 79131 - RNA, 1410 nt, Artificial Sequence
  derived and/or modified sequence opt1 from neuraminidase__InfluenzaA__ADD22755
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcaccgucagcggcugggccaucuacuccaaggacaacagcauccgcaucggcuccaagggggacguguucgugauccgggagccguucaucagcugcagcccccuggagugccgcaccuucuuccugacccagggcgcccuccugaacgacaagcacuccaacgggacgaucaaggaccggucccccuaccgcacccugaugagcugccccaucggcgaggucccgucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacagcccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcacggacaacaacuucuccaucaagcaggacaucguggggaucaacgaguggagcggcuacuccgggagcuucgugcagcaccccgagcugaccggccuggacugcauccgcccgugcuucugggucgagcucauccggggccgccccaaggagaacaccaucuggaccuccgggagcuccaucagcuucugcggcgugaacuccgacacggucggguggagcuggcccgacggcgccgagcugcccuucaccaucgacaaguga

SEQ ID NO: 79132 - RNA, 1410 nt, Artificial Sequence
  derived and/or modified sequence opt1 from neuraminidase__InfluenzaA__ADD22765
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgacugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79133 - RNA, 1410 nt, Artificial Sequence; identical to SEQ ID NO: 77746
  derived and/or modified sequence opt1 from neuraminidase__InfluenzaA__ADD22775

SEQ ID NO: 79134 - RNA, 1410 nt, Artificial Sequence; identical to SEQ ID NO: 77746
  derived and/or modified sequence opt1 from neuraminidase__InfluenzaA__ADD22785

SEQ ID NO: 79135 - RNA, 1410 nt, Artificial Sequence; identical to SEQ ID NO: 77746
  derived and/or modified sequence opt1 from neuraminidase__InfluenzaA__ADD22795

SEQ ID NO: 79136 - RNA, 1410 nt, Artificial Sequence; identical to SEQ ID NO: 77746
  derived and/or modified sequence opt1 from neuraminidase__InfluenzaA__ADD22805

SEQ ID NO: 79137 - RNA, 1410 nt, Artificial Sequence; identical to SEQ ID NO: 77746
  derived and/or modified sequence opt1 from neuraminidase__InfluenzaA__ADD22815

SEQ ID NO: 79138 - RNA, 1410 nt, Artificial Sequence; identical to SEQ ID NO: 77746
  derived and/or modified sequence opt1 from neuraminidase__InfluenzaA__ADD22825

SEQ ID NO: 79139 - RNA, 1410 nt, Artificial Sequence; identical to SEQ ID NO: 77746
  derived and/or modified sequence opt1 from neuraminidase__InfluenzaA__ADD22835

SEQ ID NO: 79140 - RNA, 1410 nt, Artificial Sequence; identical to SEQ ID NO: 77746
  derived and/or modified sequence opt1 from neuraminidase__InfluenzaA__ADD22845

SEQ ID NO: 79141 - RNA, 1410 nt, Artificial Sequence; identical to SEQ ID NO: 77746
  derived and/or modified sequence opt1 from neuraminidase__InfluenzaA__ADD22855

SEQ ID NO: 79142 - RNA, 1410 nt, Artificial Sequence; identical to SEQ ID NO: 77746
  derived and/or modified sequence opt1 from neuraminidase__InfluenzaA__ADD22924

SEQ ID NO: 79143 - RNA, 1410 nt, Artificial Sequence; identical to SEQ ID NO: 77746
  derived and/or modified sequence opt1 from neuraminidase__InfluenzaA__ADD22934

SEQ ID NO: 79144 - RNA, 1410 nt, Artificial Sequence; identical to SEQ ID NO: 77746
  derived and/or modified sequence opt1 from neuraminidase__InfluenzaA__ADD22944

SEQ ID NO: 79145 - RNA, 1410 nt, Artificial Sequence; identical to SEQ ID NO: 77746
  derived and/or modified sequence opt1 from neuraminidase__InfluenzaA__ADD22954

SEQ ID NO: 79146 - RNA, 1410 nt, Artificial Sequence; identical to SEQ ID NO: 77746
  derived and/or modified sequence opt1 from neuraminidase__InfluenzaA__ADD22974

SEQ ID NO: 79147 - RNA, 1410 nt, Artificial Sequence; identical to SEQ ID NO: 77746
  derived and/or modified sequence opt1 from neuraminidase__InfluenzaA__ADD23075

SEQ ID NO: 79148 - RNA, 1410 nt, Artificial Sequence
  derived and/or modified sequence opt1 from neuraminidase__InfluenzaA__ADD23085
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcuguucaucagcugcagcccccuggagugccgcaccuucuuccucacccagggcgcccugcugaacgacaagcacuccaacgggaccaucaaggaccggucccccuaccgcacgcucaugagcugccccaucggcgaggucccgucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccucgacugcauccgcccgugcuucugggucgagcugauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 79149 - RNA, 1410 nt, Artificial Sequence; identical to SEQ ID NO: 77746
  derived and/or modified sequence opt1 from neuraminidase__InfluenzaA__ADD23095

SEQ ID NO: 79150 - RNA, 1410 nt, Artificial Sequence; identical to SEQ ID NO: 77746
  derived and/or modified sequence opt1 from neuraminidase__InfluenzaA__ADD23105

SEQ ID NO: 79151 - RNA, 1410 nt, Artificial Sequence; identical to SEQ ID NO: 77746
  derived and/or modified sequence opt1 from neuraminidase__InfluenzaA__ADD23115

SEQ ID NO: 79152 - RNA, 1410 nt, Artificial Sequence; identical to SEQ ID NO: 77746
  derived and/or modified sequence opt1 from neuraminidase__InfluenzaA__ADD23125

SEQ ID NO: 79153 - RNA, 1410 nt, Artificial Sequence; identical to SEQ ID NO: 77746
  derived and/or modified sequence opt1 from neuraminidase__InfluenzaA__ADD23135

SEQ ID NO: 79154 - RNA, 1410 nt, Artificial Sequence; identical to SEQ ID NO: 77746
  derived and/or modified sequence opt1 from neuraminidase__InfluenzaA__ADD23145

SEQ ID NO: 79155 - RNA, 1410 nt, Artificial Sequence; identical to SEQ ID NO: 77746
  derived and/or modified sequence opt1 from neuraminidase__InfluenzaA__ADD23155

SEQ ID NO: 79156 - RNA, 1410 nt, Artificial Sequence; identical to SEQ ID NO: 77746
  derived and/or modified sequence opt1 from neuraminidase__InfluenzaA__ADD23165

SEQ ID NO: 79157 - RNA, 1410 nt, Artificial Sequence; identical to SEQ ID NO: 77746
  derived and/or modified sequence opt1 from neuraminidase__InfluenzaA__ADD23175

SEQ ID NO: 79158 - RNA, 1410 nt, Artificial Sequence; identical to SEQ ID NO: 77746
  derived and/or modified sequence opt1 from neuraminidase__InfluenzaA__ADD23185

SEQ ID NO: 79159 - RNA, 1410 nt, Artificial Sequence; identical to SEQ ID NO: 77746
  derived and/or modified sequence opt1 from neuraminidase__InfluenzaA__ADD23195

SEQ ID NO: 79160 - RNA, 1410 nt, Artificial Sequence; identical to SEQ ID NO: 77746
  derived and/or modified sequence opt1 from neuraminidase__InfluenzaA__ADD23223

SEQ ID NO: 79161 - RNA, 1410 nt, Artificial Sequence
  derived and/or modified sequence opt1 from neuraminidase__InfluenzaA__ADD23233
augaaccccaaccagaagaucaucaccaucggcagcgugugcaugaccaucgggauggccaaccugauccuccagaucggcaacaucaucuccaucuggaucgggcacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacucccgguucgagagcguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcgacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 79162 - RNA, 1410 nt, Artificial Sequence; identical to SEQ ID NO: 77746
  derived and/or modified sequence opt1 from neuraminidase__InfluenzaA__ADD23243

SEQ ID NO: 79163 - RNA, 1410 nt, Artificial Sequence; identical to SEQ ID NO: 79034
  derived and/or modified sequence opt1 from neuraminidase__InfluenzaA__ADD23253

SEQ ID NO: 79164 - RNA, 1410 nt, Artificial Sequence
  derived and/or modified sequence opt1 from neuraminidase__InfluenzaA__ADD23273
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccgagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79165 - RNA, 1410 nt, Artificial Sequence; identical to SEQ ID NO: 77746
  derived and/or modified sequence opt1 from neuraminidase__InfluenzaA__ADD23283

SEQ ID NO: 79166 - RNA, 1410 nt, Artificial Sequence; identical to SEQ ID NO: 77746
  derived and/or modified sequence opt1 from neuraminidase__InfluenzaA__ADD23293

SEQ ID NO: 79167 - RNA, 1410 nt, Artificial Sequence; identical to SEQ ID NO: 77746
  derived and/or modified sequence opt1 from neuraminidase__InfluenzaA__ADD23303

SEQ ID NO: 79168 - RNA, 1410 nt, Artificial Sequence; identical to SEQ ID NO: 77746
  derived and/or modified sequence opt1 from neuraminidase__InfluenzaA__ADD23313

SEQ ID NO: 79169 - RNA, 1410 nt, Artificial Sequence
  derived and/or modified sequence opt1 from neuraminidase__InfluenzaA__ADD23323
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugcucaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79170 - RNA, 1410 nt, Artificial Sequence; identical to SEQ ID NO: 77746
  derived and/or modified sequence opt1 from neuraminidase__InfluenzaA__ADD23333

SEQ ID NO: 79171 - RNA, 1410 nt, Artificial Sequence; identical to SEQ ID NO: 77746
  derived and/or modified sequence opt1 from neuraminidase__InfluenzaA__ADD23358

SEQ ID NO: 79172 - RNA, 1410 nt, Artificial Sequence; identical to SEQ ID NO: 79097
  derived and/or modified sequence opt1 from neuraminidase__InfluenzaA__ADD23368

SEQ ID NO: 79173 - RNA, 1410 nt, Artificial Sequence; identical to SEQ ID NO: 77746
  derived and/or modified sequence opt1 from neuraminidase__InfluenzaA__ADD23378

SEQ ID NO: 79174 - RNA, 1410 nt, Artificial Sequence; identical to SEQ ID NO: 77746
  derived and/or modified sequence opt1 from neuraminidase__InfluenzaA__ADD23388

SEQ ID NO: 79175 - RNA, 1410 nt, Artificial Sequence; identical to SEQ ID NO: 78329
  derived and/or modified sequence opt1 from neuraminidase__InfluenzaA__ADD23398

SEQ ID NO: 79176 - RNA, 1410 nt, Artificial Sequence
  derived and/or modified sequence opt1 from neuraminidase__InfluenzaA__ADD23408
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccaggaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79177 - RNA, 1410 nt, Artificial Sequence
  derived and/or modified sequence opt1 from neuraminidase__InfluenzaA__ADD23438
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacagcuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79178 - RNA, 1410 nt, Artificial Sequence; identical to SEQ ID NO: 77746
  derived and/or modified sequence opt1 from neuraminidase__InfluenzaA__ADD23448

SEQ ID NO: 79179 - RNA, 1410 nt, Artificial Sequence; identical to SEQ ID NO: 77746
  derived and/or modified sequence opt1 from neuraminidase__InfluenzaA__ADD23458

SEQ ID NO: 79180 - RNA, 1410 nt, Artificial Sequence
  derived and/or modified sequence opt1 from neuraminidase__InfluenzaA__ADD23468
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucgugggggugaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79181 - RNA, 1410 nt, Artificial Sequence; identical to SEQ ID NO: 77746
  derived and/or modified sequence opt1 from neuraminidase__InfluenzaA__ADD23478

SEQ ID NO: 79182 - RNA, 1410 nt, Artificial Sequence; identical to SEQ ID NO: 77746
  derived and/or modified sequence opt1 from neuraminidase__InfluenzaA__ADD23488

SEQ ID NO: 79183 - RNA, 1410 nt, Artificial Sequence
  derived and/or modified sequence opt1 from neuraminidase__InfluenzaA__ADD23498
augaaccccaaccagaagaucaucaccaucggcagcgugugcaugaccaucgggauggccaaccugauccuccagaucggcaacaucaucuccaucuggaucagccacuccauccagcuggggaaccagaaccacaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79184 - RNA, 1410 nt, Artificial Sequence; identical to SEQ ID NO: 77746
  derived and/or modified sequence opt1 from neuraminidase__InfluenzaA__ADD23508

SEQ ID NO: 79185 - RNA, 1410 nt, Artificial Sequence; identical to SEQ ID NO: 77746
  derived and/or modified sequence opt1 from neuraminidase__InfluenzaA__ADD23518

SEQ ID NO: 79186 - RNA, 1410 nt, Artificial Sequence; identical to SEQ ID NO: 77746
  derived and/or modified sequence opt1 from neuraminidase__InfluenzaA__ADD23997

SEQ ID NO: 79187 - RNA, 1410 nt, Artificial Sequence; identical to SEQ ID NO: 77746
  derived and/or modified sequence opt1 from neuraminidase__InfluenzaA__ADD24007

SEQ ID NO: 79188 - RNA, 1410 nt, Artificial Sequence; identical to SEQ ID NO: 77746
  derived and/or modified sequence opt1 from neuraminidase__InfluenzaA__ADD24017

SEQ ID NO: 79189 - RNA, 1410 nt, Artificial Sequence; identical to SEQ ID NO: 77746
  derived and/or modified sequence opt1 from neuraminidase__InfluenzaA__ADD24024

SEQ ID NO: 79190 - RNA, 1410 nt, Artificial Sequence; identical to SEQ ID NO: 77746
  derived and/or modified sequence opt1 from neuraminidase__InfluenzaA__ADD24025

SEQ ID NO: 79191 - RNA, 1410 nt, Artificial Sequence; identical to SEQ ID NO: 77746
  derived and/or modified sequence opt1 from neuraminidase__InfluenzaA__ADD24026

SEQ ID NO: 79192 - RNA, 1410 nt, Artificial Sequence; identical to SEQ ID NO: 77746
  derived and/or modified sequence opt1 from neuraminidase__InfluenzaA__ADD24027

SEQ ID NO: 79193 - RNA, 1410 nt, Artificial Sequence; identical to SEQ ID NO: 77746
  derived and/or modified sequence opt1 from neuraminidase__InfluenzaA__ADD24028

SEQ ID NO: 79194 - RNA, 1410 nt, Artificial Sequence; identical to SEQ ID NO: 77746
  derived and/or modified sequence opt1 from neuraminidase__InfluenzaA__ADD24029

SEQ ID NO: 79195 - RNA, 1410 nt, Artificial Sequence; identical to SEQ ID NO: 77746
  derived and/or modified sequence opt1 from neuraminidase__InfluenzaA__ADD24030

SEQ ID NO: 79196 - RNA, 1410 nt, Artificial Sequence; identical to SEQ ID NO: 77746
  derived and/or modified sequence opt1 from neuraminidase__InfluenzaA__ADD24031

SEQ ID NO: 79197 - RNA, 1410 nt, Artificial Sequence; identical to SEQ ID NO: 77746
  derived and/or modified sequence opt1 from neuraminidase__InfluenzaA__ADD24032

SEQ ID NO: 79198 - RNA, 1410 nt, Artificial Sequence; identical to SEQ ID NO: 77746
  derived and/or modified sequence opt1 from neuraminidase__InfluenzaA__ADD25231

SEQ ID NO: 79199 - RNA, 1410 nt, Artificial Sequence; identical to SEQ ID NO: 77746
  derived and/or modified sequence opt1 from neuraminidase__InfluenzaA__ADD25233

SEQ ID NO: 79200 - RNA, 1410 nt, Artificial Sequence; identical to SEQ ID NO: 77746
  derived and/or modified sequence opt1 from neuraminidase__InfluenzaA__ADD25235

SEQ ID NO: 79201 - RNA, 1410 nt, Artificial Sequence; identical to SEQ ID NO: 77746
  derived and/or modified sequence opt1 from neuraminidase__InfluenzaA__ADD25244

SEQ ID NO: 79202 - RNA, 1410 nt, Artificial Sequence
  derived and/or modified sequence opt1 from neuraminidase__InfluenzaA__ADD25246
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaccaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 79203 - RNA, 1410 nt, Artificial Sequence; identical to SEQ ID NO: 77746
  derived and/or modified sequence opt1 from neuraminidase__InfluenzaA__ADD25248

SEQ ID NO: 79204 - RNA, 1410 nt, Artificial Sequence
  derived and/or modified sequence opt1 from neuraminidase__InfluenzaA__ADD25250
augaaccccaaccagaagaucaucaccaucggcagcgugugcaugaccaucgggauggccaaccugauccuccagaucggcaacaucaucuccaucuggaucagccgcuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccggaucggcuccaagggggacgucuucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccgacggccaggccagcuacaagaucuuccggaucgagaaggggaagaucgugaaguccgucgagaugaacgcccccaacuaccacuacgaggagugcagcugcuaccccgacuccggcgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggcuccugcgggcccgucagcuccaacggcgccaacggggugaagggcuucagcuucaaguacgggaacggcguguggaucggccggaccaaguccaucagcagccgcaacggguucgagaugaucugggaccccaacggcuggaccgggaccgacaacaacuucuccaucaagcaggacaucgucggcaucaacgaguggagcggguacuccggcagcuucgugcagcacccggagcugacgggccuggacugcauccggcccugcuucuggguggagcucauccgcgggcggcccaaggagaacaccaucuggaccuccggcagcuccaucagcuucugcggggucaacuccgacaccaugggcuggagcuggcccgacggcgccgagcugccguucacgaucgacaaguga

SEQ ID NO: 79205 - RNA, 1410 nt, Artificial Sequence; identical to SEQ ID NO: 77746
  derived and/or modified sequence opt1 from neuraminidase__InfluenzaA__ADD25255

SEQ ID NO: 79206 - RNA, 1410 nt, Artificial Sequence; identical to SEQ ID NO: 77746
  derived and/or modified sequence opt1 from neuraminidase__InfluenzaA__ADD25259

SEQ ID NO: 79207 - RNA, 1410 nt, Artificial Sequence
  derived and/or modified sequence opt1 from neuraminidase__InfluenzaA__ADD25262
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccgacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79208 - RNA, 1410 nt, Artificial Sequence
  derived and/or modified sequence opt1 from neuraminidase__InfluenzaA__ADD25266
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 79209 - RNA, 1410 nt, Artificial Sequence; identical to SEQ ID NO: 77746
  derived and/or modified sequence opt1 from neuraminidase__InfluenzaA__ADD25268

SEQ ID NO: 79210 - RNA, 1410 nt, Artificial Sequence; identical to SEQ ID NO: 77746
  derived and/or modified sequence opt1 from neuraminidase__InfluenzaA__ADD25271

SEQ ID NO: 79211 - RNA, 1410 nt, Artificial Sequence; identical to SEQ ID NO: 77746
  derived and/or modified sequence opt1 from neuraminidase__InfluenzaA__ADD25274

SEQ ID NO: 79212 - RNA, 1410 nt, Artificial Sequence; identical to SEQ ID NO: 77746
  derived and/or modified sequence opt1 from neuraminidase__InfluenzaA__ADD25276

SEQ ID NO: 79213 - RNA, 1410 nt, Artificial Sequence
  derived and/or modified sequence opt1 from neuraminidase__InfluenzaA__ADD25278
augaaccccaaccagaagaucaucaccaucggcagcgugugcaugaccaucgggauggccaaccugauccuccagaucggcaacaucaucuccaucuggaucagccgcuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccggaucggcuccaagggggacgucuucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccgacggccaggccagcuacaagaucuuccggaucgagaaggggaagaucgugaaguccgucgagaugaacgcccccaacuaccacuacgaggagugcagcugcuaccccgacuccggcgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggcuccugcgggcccgucagcuccaacggcgccaacggggugaagggcuucagcuucaaguacgggaacggcguguggaucggccggaccaaguccaucagcagccgcaacggguucgagaugaucugggaccccaacggcuggaccgggaccgacaacaacuucuccaucaagcaggacaucgucggcaucaacgaguggagcggguacuccggcagcuucgugcagcacccggagcugacgggccuggacugcauccggcccugcuucuggguggagcucauccgcgggcggcccaaggagaacaccaucuggaccuccggcagcuccaucagcuucugcggggucaacuccgacaccgugggcuggagcuggcccgacggcgccgagcugccguucacgaucgacaaguga

SEQ ID NO: 79214 - RNA, 1410 nt, Artificial Sequence; identical to SEQ ID NO: 77746
  derived and/or modified sequence opt1 from neuraminidase__InfluenzaA__ADD25280

SEQ ID NO: 79215 - RNA, 1410 nt, Artificial Sequence; identical to SEQ ID NO: 77746
  derived and/or modified sequence opt1 from neuraminidase__InfluenzaA__ADD25282

SEQ ID NO: 79216 - RNA, 1410 nt, Artificial Sequence; identical to SEQ ID NO: 79034
  derived and/or modified sequence opt1 from neuraminidase__InfluenzaA__ADD25284

SEQ ID NO: 79217 - RNA, 1410 nt, Artificial Sequence; identical to SEQ ID NO: 77746
  derived and/or modified sequence opt1 from neuraminidase__InfluenzaA__ADD25287

SEQ ID NO: 79218 - RNA, 1410 nt, Artificial Sequence; identical to SEQ ID NO: 77746
  derived and/or modified sequence opt1 from neuraminidase__InfluenzaA__ADD25291

SEQ ID NO: 79219 - RNA, 1410 nt, Artificial Sequence; identical to SEQ ID NO: 79034
  derived and/or modified sequence opt1 from neuraminidase__InfluenzaA__ADD25293

SEQ ID NO: 79220 - RNA, 1410 nt, Artificial Sequence; identical to SEQ ID NO: 77746
  derived and/or modified sequence opt1 from neuraminidase__InfluenzaA__ADD25300

SEQ ID NO: 79221 - RNA, 1410 nt, Artificial Sequence
  derived and/or modified sequence opt1 from neuraminidase__InfluenzaA__ADD25304
augaaccccaaccagaagaucaucaccaucggcagcgugugcaugaccaucgggauggccaaccugauccuccagaucggcaacaucgucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79222 - RNA, 1410 nt, Artificial Sequence
  derived and/or modified sequence opt1 from neuraminidase__InfluenzaA__ADD25306
augaaccccaaccagaagaucaucaccaucggcagcgugugcaugaccaucgggauggccaaccugauccuccagaucggcaacaucaucuccaucuggaucagccgcuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccggaucggcuccaagggggacgucuucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacgagccguccgacggccaggccagcuacaagaucuuccggaucgagaagggcaagaucgugaaguccgucgagaugaacgcccccaacuaccacuacgaggagugcagcugcuaccccgacuccggggagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuucaaguacggcaacgggguguggaucggccggaccaaguccaucagcagccgcaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 79223 - RNA, 1410 nt, Artificial Sequence; identical to SEQ ID NO: 77746
  derived and/or modified sequence opt1 from neuraminidase__InfluenzaA__ADD25308

SEQ ID NO: 79224 - RNA, 1410 nt, Artificial Sequence; identical to SEQ ID NO: 77746
  derived and/or modified sequence opt1 from neuraminidase__InfluenzaA__ADD25310

SEQ ID NO: 79225 - RNA, 1410 nt, Artificial Sequence; identical to SEQ ID NO: 77746
  derived and/or modified sequence opt1 from neuraminidase__InfluenzaA__ADD25312

SEQ ID NO: 79226 - RNA, 1410 nt, Artificial Sequence; identical to SEQ ID NO: 77746
  derived and/or modified sequence opt1 from neuraminidase__InfluenzaA__ADD25314

SEQ ID NO: 79227 - RNA, 1410 nt, Artificial Sequence; identical to SEQ ID NO: 77746
  derived and/or modified sequence opt1 from neuraminidase__InfluenzaA__ADD25316

SEQ ID NO: 79228 - RNA, 1410 nt, Artificial Sequence; identical to SEQ ID NO: 77746
  derived and/or modified sequence opt1 from neuraminidase__InfluenzaA__ADD29799

SEQ ID NO: 79229 - RNA, 1410 nt, Artificial Sequence; identical to SEQ ID NO: 77746
  derived and/or modified sequence opt1 from neuraminidase__InfluenzaA__ADD29800

SEQ ID NO: 79230 - RNA, 1410 nt, Artificial Sequence; identical to SEQ ID NO: 77746
  derived and/or modified sequence opt1 from neuraminidase__InfluenzaA__ADD29801

SEQ ID NO: 79231 - RNA, 1410 nt, Artificial Sequence; identical to SEQ ID NO: 77746
  derived and/or modified sequence opt1 from neuraminidase__InfluenzaA__ADD29802

SEQ ID NO: 79232 - RNA, 1410 nt, Artificial Sequence; identical to SEQ ID NO: 77746
  derived and/or modified sequence opt1 from neuraminidase__InfluenzaA__ADD29803

SEQ ID NO: 79233 - RNA, 1410 nt, Artificial Sequence; identical to SEQ ID NO: 77746
  derived and/or modified sequence opt1 from neuraminidase__InfluenzaA__ADD29804

SEQ ID NO: 79234 - RNA, 1410 nt, Artificial Sequence; identical to SEQ ID NO: 77746
  derived and/or modified sequence opt1 from neuraminidase__InfluenzaA__ADD29805

SEQ ID NO: 79235 - RNA, 1410 nt, Artificial Sequence; identical to SEQ ID NO: 77746
  derived and/or modified sequence opt1 from neuraminidase__InfluenzaA__ADD29806

SEQ ID NO: 79236 - RNA, 1410 nt, Artificial Sequence; identical to SEQ ID NO: 77746
  derived and/or modified sequence opt1 from neuraminidase__InfluenzaA__ADD29807

SEQ ID NO: 79237 - RNA, 1410 nt, Artificial Sequence; identical to SEQ ID NO: 77746
  derived and/or modified sequence opt1 from neuraminidase__InfluenzaA__ADD29808

SEQ ID NO: 79238 - RNA, 1410 nt, Artificial Sequence; identical to SEQ ID NO: 77746
  derived and/or modified sequence opt1 from neuraminidase__InfluenzaA__ADD52538

SEQ ID NO: 79239 - RNA, 1410 nt, Artificial Sequence; identical to SEQ ID NO: 78969
  derived and/or modified sequence opt1 from neuraminidase__InfluenzaA__ADD74353

SEQ ID NO: 79240 - RNA, 1410 nt, Artificial Sequence; identical to SEQ ID NO: 77746
  derived and/or modified sequence opt1 from neuraminidase__InfluenzaA__ADD74373

SEQ ID NO: 79241 - RNA, 1410 nt, Artificial Sequence; identical to SEQ ID NO: 77746
  derived and/or modified sequence opt1 from neuraminidase__InfluenzaA__ADD74383

SEQ ID NO: 79242 - RNA, 1410 nt, Artificial Sequence; identical to SEQ ID NO: 77746
  derived and/or modified sequence opt1 from neuraminidase__InfluenzaA__ADD74401

SEQ ID NO: 79243 - RNA, 1410 nt, Artificial Sequence
  derived and/or modified sequence opt1 from neuraminidase__InfluenzaA__ADD74411
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacgucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcagcgggguguggaucggccgcaccaagagcaucuccagccgguccggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79244 - RNA, 1410 nt, Artificial Sequence; identical to SEQ ID NO: 77746
  derived and/or modified sequence opt1 from neuraminidase__InfluenzaA__ADD74421

SEQ ID NO: 79245 - RNA, 1410 nt, Artificial Sequence; identical to SEQ ID NO: 77746
  derived and/or modified sequence opt1 from neuraminidase__InfluenzaA__ADD74431

SEQ ID NO: 79246 - RNA, 1410 nt, Artificial Sequence
  derived and/or modified sequence opt1 from neuraminidase__InfluenzaA__ADD74441
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaucuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79247 - RNA, 1410 nt, Artificial Sequence; identical to SEQ ID NO: 77746
  derived and/or modified sequence opt1 from neuraminidase__InfluenzaA__ADD74451

SEQ ID NO: 79248 - RNA, 1410 nt, Artificial Sequence; identical to SEQ ID NO: 77746
  derived and/or modified sequence opt1 from neuraminidase__InfluenzaA__ADD74461

SEQ ID NO: 79249 - RNA, 1410 nt, Artificial Sequence; identical to SEQ ID NO: 77746
  derived and/or modified sequence opt1 from neuraminidase__InfluenzaA__ADD74471

SEQ ID NO: 79250 - RNA, 1410 nt, Artificial Sequence; identical to SEQ ID NO: 77746
  derived and/or modified sequence opt1 from neuraminidase__InfluenzaA__ADD74481

SEQ ID NO: 79251 - RNA, 1410 nt, Artificial Sequence; identical to SEQ ID NO: 78763
  derived and/or modified sequence opt1 from neuraminidase__InfluenzaA__ADD74491

SEQ ID NO: 79252 - RNA, 1410 nt, Artificial Sequence; identical to SEQ ID NO: 77746
  derived and/or modified sequence opt1 from neuraminidase__InfluenzaA__ADD74501

SEQ ID NO: 79253 - RNA, 1410 nt, Artificial Sequence; identical to SEQ ID NO: 77746
  derived and/or modified sequence opt1 from neuraminidase__InfluenzaA__ADD74511

SEQ ID NO: 79254 - RNA, 1410 nt, Artificial Sequence; identical to SEQ ID NO: 78764
  derived and/or modified sequence opt1 from neuraminidase__InfluenzaA__ADD74521

SEQ ID NO: 79255 - RNA, 1410 nt, Artificial Sequence; identical to SEQ ID NO: 77746
  derived and/or modified sequence opt1 from neuraminidase__InfluenzaA__ADD74531

SEQ ID NO: 79256 - RNA, 1410 nt, Artificial Sequence
  derived and/or modified sequence opt1 from neuraminidase__InfluenzaA__ADD74551
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacuacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79257 - RNA, 1410 nt, Artificial Sequence; identical to SEQ ID NO: 77746
  derived and/or modified sequence opt1 from neuraminidase__InfluenzaA__ADD74561

SEQ ID NO: 79258 - RNA, 1410 nt, Artificial Sequence; identical to SEQ ID NO: 77746
  derived and/or modified sequence opt1 from neuraminidase__InfluenzaA__ADD74571

SEQ ID NO: 79259 - RNA, 1410 nt, Artificial Sequence
  derived and/or modified sequence opt1 from neuraminidase__InfluenzaA__ADD74581
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacgccgucgggugguccuggcccgacggcgcggagcugccguucaccaucgacaaguga

SEQ ID NO: 79260 - RNA, 1410 nt, Artificial Sequence; identical to SEQ ID NO: 77746
  derived and/or modified sequence opt1 from neuraminidase__InfluenzaA__ADD74591

SEQ ID NO: 79261 - RNA, 1410 nt, Artificial Sequence; identical to SEQ ID NO: 77746
  derived and/or modified sequence opt1 from neuraminidase__InfluenzaA__ADD74601

SEQ ID NO: 79262 - RNA, 1410 nt, Artificial Sequence
  derived and/or modified sequence opt1 from neuraminidase__InfluenzaA__ADD74611
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcaucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79263 - RNA, 1410 nt, Artificial Sequence; identical to SEQ ID NO: 77746
  derived and/or modified sequence opt1 from neuraminidase__InfluenzaA__ADD74621

SEQ ID NO: 79264 - RNA, 1410 nt, Artificial Sequence; identical to SEQ ID NO: 77746
  derived and/or modified sequence opt1 from neuraminidase__InfluenzaA__ADD74631

SEQ ID NO: 79265 - RNA, 1410 nt, Artificial Sequence; identical to SEQ ID NO: 77746
  derived and/or modified sequence opt1 from neuraminidase__InfluenzaA__ADD74641

SEQ ID NO: 79266 - RNA, 1410 nt, Artificial Sequence; identical to SEQ ID NO: 77746
  derived and/or modified sequence opt1 from neuraminidase__InfluenzaA__ADD74651

SEQ ID NO: 79267 - RNA, 1410 nt, Artificial Sequence; identical to SEQ ID NO: 79097
  derived and/or modified sequence opt1 from neuraminidase__InfluenzaA__ADD74661

SEQ ID NO: 79268 - RNA, 1410 nt, Artificial Sequence; identical to SEQ ID NO: 77746
  derived and/or modified sequence opt1 from neuraminidase__InfluenzaA__ADD74671

SEQ ID NO: 79269 - RNA, 1410 nt, Artificial Sequence; identical to SEQ ID NO: 77746
  derived and/or modified sequence opt1 from neuraminidase__InfluenzaA__ADD74681

SEQ ID NO: 79270 - RNA, 1410 nt, Artificial Sequence
  derived and/or modified sequence opt1 from neuraminidase__InfluenzaA__ADD74691
augaaccccaaccagaagaucaucaccaucggcagcgugugcaugaccaucgggauggccaaccugauccuccagaucggcaacaucaucuccaucuggaucugccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79271 - RNA, 1410 nt, Artificial Sequence; identical to SEQ ID NO: 77746
  derived and/or modified sequence opt1 from neuraminidase__InfluenzaA__ADD74701

SEQ ID NO: 79272 - RNA, 1410 nt, Artificial Sequence; identical to SEQ ID NO: 77746
  derived and/or modified sequence opt1 from neuraminidase__InfluenzaA__ADD74711

SEQ ID NO: 79273 - RNA, 1410 nt, Artificial Sequence; identical to SEQ ID NO: 77746
  derived and/or modified sequence opt1 from neuraminidase__InfluenzaA__ADD74721

SEQ ID NO: 79274 - RNA, 1410 nt, Artificial Sequence; identical to SEQ ID NO: 77746
  derived and/or modified sequence opt1 from neuraminidase__InfluenzaA__ADD74731

SEQ ID NO: 79275 - RNA, 1410 nt, Artificial Sequence
  derived and/or modified sequence opt1 from neuraminidase__InfluenzaA__ADD74741
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 79276 - RNA, 1410 nt, Artificial Sequence
  derived and/or modified sequence opt1 from neuraminidase__InfluenzaA__ADD74751
augaaccccaaccagaagaucaucaccaucggcagcgugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucaaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaugaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79277 - RNA, 1410 nt, Artificial Sequence
  derived and/or modified sequence opt1 from neuraminidase__InfluenzaA__ADD74761
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcaucaacagcgacaccguggggugguccuggcccgacggcgccgagcugccguucacgaucgacaaguga

SEQ ID NO: 79278 - RNA, 1410 nt, Artificial Sequence; identical to SEQ ID NO: 77746
  derived and/or modified sequence opt1 from neuraminidase__InfluenzaA__ADD74791

SEQ ID NO: 79279 - RNA, 1410 nt, Artificial Sequence; identical to SEQ ID NO: 78329
  derived and/or modified sequence opt1 from neuraminidase__InfluenzaA__ADD74811

SEQ ID NO: 79280 - RNA, 1410 nt, Artificial Sequence; identical to SEQ ID NO: 77746
  derived and/or modified sequence opt1 from neuraminidase__InfluenzaA__ADD74821

SEQ ID NO: 79281 - RNA, 1410 nt, Artificial Sequence
  derived and/or modified sequence opt1 from neuraminidase__InfluenzaA__ADD74831
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugccucaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccucgacugcauccgccccugcuucuggguggagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79282 - RNA, 1410 nt, Artificial Sequence; identical to SEQ ID NO: 77746
  derived and/or modified sequence opt1 from neuraminidase__InfluenzaA__ADD74841

SEQ ID NO: 79283 - RNA, 1410 nt, Artificial Sequence; identical to SEQ ID NO: 77746
  derived and/or modified sequence opt1 from neuraminidase__InfluenzaA__ADD74851

SEQ ID NO: 79284 - RNA, 1410 nt, Artificial Sequence; identical to SEQ ID NO: 78853
  derived and/or modified sequence opt1 from neuraminidase__InfluenzaA__ADD74861

SEQ ID NO: 79285 - RNA, 1410 nt, Artificial Sequence; identical to SEQ ID NO: 77746
  derived and/or modified sequence opt1 from neuraminidase__InfluenzaA__ADD74871

SEQ ID NO: 79286 - RNA, 1410 nt, Artificial Sequence; identical to SEQ ID NO: 77746
  derived and/or modified sequence opt1 from neuraminidase__InfluenzaA__ADD74881

SEQ ID NO: 79287 - RNA, 1410 nt, Artificial Sequence; identical to SEQ ID NO: 77746
  derived and/or modified sequence opt1 from neuraminidase__InfluenzaA__ADD74891

SEQ ID NO: 79288 - RNA, 1410 nt, Artificial Sequence; identical to SEQ ID NO: 77746
  derived and/or modified sequence opt1 from neuraminidase__InfluenzaA__ADD74901

SEQ ID NO: 79289 - RNA, 1410 nt, Artificial Sequence; identical to SEQ ID NO: 77746
  derived and/or modified sequence opt1 from neuraminidase__InfluenzaA__ADD74911

SEQ ID NO: 79290 - RNA, 1410 nt, Artificial Sequence; identical to SEQ ID NO: 77746
  derived and/or modified sequence opt1 from neuraminidase__InfluenzaA__ADD74921

SEQ ID NO: 79291 - RNA, 1410 nt, Artificial Sequence; identical to SEQ ID NO: 77746
  derived and/or modified sequence opt1 from neuraminidase__InfluenzaA__ADD74941

SEQ ID NO: 79292 - RNA, 1410 nt, Artificial Sequence
  derived and/or modified sequence opt1 from neuraminidase__InfluenzaA__ADD74961
augaaccccaaccagaagaucaucaccaucggcagcgugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccacaccuacgugaacaucuccaacacgaacuucgccgcggggcagagcgucguguccgugaagcuggccggcaacagcucccucugcccggucagcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucggcaucuccgggcccgacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggcccguccgacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 79293 - RNA, 1410 nt, Artificial Sequence; identical to SEQ ID NO: 77746
  derived and/or modified sequence opt1 from neuraminidase__InfluenzaA__ADD74971

SEQ ID NO: 79294 - RNA, 1410 nt, Artificial Sequence
  derived and/or modified sequence opt1 from neuraminidase__InfluenzaA__ADD74981
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggagcggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccgaggagaacaccaucuggaccuccgggagcuccaucagcuucugcggcgucaacuccgacaccgugggguggagcuggcccgacggcgccgagcugccguucacgaucgacaaguga

SEQ ID NO: 79295 - RNA, 1410 nt, Artificial Sequence; identical to SEQ ID NO: 77746
  derived and/or modified sequence opt1 from neuraminidase__InfluenzaA__ADD74991

SEQ ID NO: 79296 - RNA, 1410 nt, Artificial Sequence; identical to SEQ ID NO: 77746
  derived and/or modified sequence opt1 from neuraminidase__InfluenzaA__ADD75001

SEQ ID NO: 79297 - RNA, 1410 nt, Artificial Sequence
  derived and/or modified sequence opt1 from neuraminidase__InfluenzaA__ADD75011
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcgaccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 79298 - RNA, 1410 nt, Artificial Sequence; identical to SEQ ID NO: 79034
  derived and/or modified sequence opt1 from neuraminidase__InfluenzaA__ADD75031

SEQ ID NO: 79299 - RNA, 1410 nt, Artificial Sequence
  derived and/or modified sequence opt1 from neuraminidase__InfluenzaA__ADD75041
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79300 - RNA, 1410 nt, Artificial Sequence; identical to SEQ ID NO: 77746
  derived and/or modified sequence opt1 from neuraminidase__InfluenzaA__ADD75051

SEQ ID NO: 79301 - RNA, 1410 nt, Artificial Sequence; identical to SEQ ID NO: 77746
  derived and/or modified sequence opt1 from neuraminidase__InfluenzaA__ADD75061

SEQ ID NO: 79302 - RNA, 1410 nt, Artificial Sequence; identical to SEQ ID NO: 77746
  derived and/or modified sequence opt1 from neuraminidase__InfluenzaA__ADD75071

SEQ ID NO: 79303 - RNA, 1410 nt, Artificial Sequence; identical to SEQ ID NO: 77746
  derived and/or modified sequence opt1 from neuraminidase__InfluenzaA__ADD75081

SEQ ID NO: 79304 - RNA, 1410 nt, Artificial Sequence
  derived and/or modified sequence opt1 from neuraminidase__InfluenzaA__ADD75091
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79305 - RNA, 1410 nt, Artificial Sequence; identical to SEQ ID NO: 77746
  derived and/or modified sequence opt1 from neuraminidase__InfluenzaA__ADD75101

SEQ ID NO: 79306 - RNA, 1410 nt, Artificial Sequence; identical to SEQ ID NO: 77746
  derived and/or modified sequence opt1 from neuraminidase__InfluenzaA__ADD75111

SEQ ID NO: 79307 - RNA, 1410 nt, Artificial Sequence; identical to SEQ ID NO: 77746
  derived and/or modified sequence opt1 from neuraminidase__InfluenzaA__ADD75121

SEQ ID NO: 79308 - RNA, 1410 nt, Artificial Sequence; identical to SEQ ID NO: 77746
  derived and/or modified sequence opt1 from neuraminidase__InfluenzaA__ADD75131

SEQ ID NO: 79309 - RNA, 1410 nt, Artificial Sequence; identical to SEQ ID NO: 77746
  derived and/or modified sequence opt1 from neuraminidase__InfluenzaA__ADD75141

SEQ ID NO: 79310 - RNA, 1410 nt, Artificial Sequence
  derived and/or modified sequence opt1 from neuraminidase__InfluenzaA__ADD75161
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccagcuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguacaagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgaccgguga

SEQ ID NO: 79311 - RNA, 1410 nt, Artificial Sequence
  derived and/or modified sequence opt1 from neuraminidase__InfluenzaA__ADD84500
augaaccccaaccagaacaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaucgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79312 - RNA, 1410 nt, Artificial Sequence
  derived and/or modified sequence opt1 from neuraminidase__InfluenzaA__ADD84502
augaaccccaaccagaacaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79313 - RNA, 1410 nt, Artificial Sequence; identical to SEQ ID NO: 79312
  derived and/or modified sequence opt1 from neuraminidase__InfluenzaA__ADD84503

SEQ ID NO: 79314 - RNA, 1410 nt, Artificial Sequence
  derived and/or modified sequence opt1 from neuraminidase__InfluenzaA__ADD84504
augaaccccaaccagaacaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacuucagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79315 - RNA, 1410 nt, Artificial Sequence; identical to SEQ ID NO: 79312
  derived and/or modified sequence opt1 from neuraminidase__InfluenzaA__ADD84505

SEQ ID NO: 79316 - RNA, 1410 nt, Artificial Sequence; identical to SEQ ID NO: 79312
  derived and/or modified sequence opt1 from neuraminidase__InfluenzaA__ADD84506

SEQ ID NO: 79317 - RNA, 1410 nt, Artificial Sequence
  derived and/or modified sequence opt1 from neuraminidase__InfluenzaA__ADD92528
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggccacagcggguccagcgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79318 - RNA, 1410 nt, Artificial Sequence; identical to SEQ ID NO: 78969
  derived and/or modified sequence opt1 from neuraminidase__InfluenzaA__ADD96769

SEQ ID NO: 79319 - RNA, 1410 nt, Artificial Sequence; identical to SEQ ID NO: 78969
  derived and/or modified sequence opt1 from neuraminidase__InfluenzaA__ADD96779

SEQ ID NO: 79320 - RNA, 1410 nt, Artificial Sequence; identical to SEQ ID NO: 78969
  derived and/or modified sequence opt1 from neuraminidase__InfluenzaA__ADD96789

SEQ ID NO: 79321 - RNA, 1410 nt, Artificial Sequence; identical to SEQ ID NO: 79097
  derived and/or modified sequence opt1 from neuraminidase__InfluenzaA__ADD96799

SEQ ID NO: 79322 - RNA, 1410 nt, Artificial Sequence; identical to SEQ ID NO: 77746
  derived and/or modified sequence opt1 from neuraminidase__InfluenzaA__ADD96809

SEQ ID NO: 79323 - RNA, 1410 nt, Artificial Sequence
  derived and/or modified sequence opt1 from neuraminidase__InfluenzaA__ADD96819
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 79324 - RNA, 1410 nt, Artificial Sequence; identical to SEQ ID NO: 77746
  derived and/or modified sequence opt1 from neuraminidase__InfluenzaA__ADD96829

SEQ ID NO: 79325 - RNA, 1410 nt, Artificial Sequence; identical to SEQ ID NO: 77746
  derived and/or modified sequence opt1 from neuraminidase__InfluenzaA__ADD96839

SEQ ID NO: 79326 - RNA, 1410 nt, Artificial Sequence; identical to SEQ ID NO: 77746
  derived and/or modified sequence opt1 from neuraminidase__InfluenzaA__ADD96849

SEQ ID NO: 79327 - RNA, 1410 nt, Artificial Sequence; identical to SEQ ID NO: 77746
  derived and/or modified sequence opt1 from neuraminidase__InfluenzaA__ADD96859

SEQ ID NO: 79328 - RNA, 1410 nt, Artificial Sequence
  derived and/or modified sequence opt1 from neuraminidase__InfluenzaA__ADD96869
augaaccccaaccagaagaucaucaccaucggcagcgugugcaugaccaucgggauggccaaccugauccuccagaucggcaacaucaucuccaucuggaucagccacccgauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggaagaacaacauccugcgcacgcaggagagcgagugcgcgugcgugaacggguccugcuucaccgugaugaccgacggccccagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccgugggucuccuucaaccagaaccucgaguaccagaucggguacaucugcagcggcaucuucggggacaacccccgccccaacgacaagaccggcuccugcggccccgugagcuccaacggggccaacggcgugaagggguucagcuucaaguacggcaacggggucuggaucggccggaccaaguccaucagcagccgcaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccggcccugcuucugggucgagcucauccgcggccggcccaaggagaacaccaucuggaccuccgggagcuccaucagcuucugcggcgugaacuccgacaccgucggguggagcuggccggacggcgccgagcugcccuucacgaucgacaaguga

SEQ ID NO: 79329 - RNA, 1410 nt, Artificial Sequence
  derived and/or modified sequence opt1 from neuraminidase__InfluenzaA__ADD96879
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccugggcugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 79330 - RNA, 1410 nt, Artificial Sequence; identical to SEQ ID NO: 77746
  derived and/or modified sequence opt1 from neuraminidase__InfluenzaA__ADD96889

SEQ ID NO: 79331 - RNA, 1410 nt, Artificial Sequence; identical to SEQ ID NO: 78329
  derived and/or modified sequence opt1 from neuraminidase__InfluenzaA__ADD96899

SEQ ID NO: 79332 - RNA, 1410 nt, Artificial Sequence; identical to SEQ ID NO: 77746
  derived and/or modified sequence opt1 from neuraminidase__InfluenzaA__ADD96909

SEQ ID NO: 79333 - RNA, 1410 nt, Artificial Sequence; identical to SEQ ID NO: 77746
  derived and/or modified sequence opt1 from neuraminidase__InfluenzaA__ADD96919

SEQ ID NO: 79334 - RNA, 1410 nt, Artificial Sequence; identical to SEQ ID NO: 77746
  derived and/or modified sequence opt1 from neuraminidase__InfluenzaA__ADD96929

SEQ ID NO: 79335 - RNA, 1410 nt, Artificial Sequence; identical to SEQ ID NO: 77746
  derived and/or modified sequence opt1 from neuraminidase__InfluenzaA__ADD96939

SEQ ID NO: 79336 - RNA, 1410 nt, Artificial Sequence; identical to SEQ ID NO: 77746
  derived and/or modified sequence opt1 from neuraminidase__InfluenzaA__ADD96959

SEQ ID NO: 79337 - RNA, 1410 nt, Artificial Sequence; identical to SEQ ID NO: 77746
  derived and/or modified sequence opt1 from neuraminidase__InfluenzaA__ADD96969

SEQ ID NO: 79338 - RNA, 1410 nt, Artificial Sequence
  derived and/or modified sequence opt1 from neuraminidase__InfluenzaA__ADD96989
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccagcuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 79339 - RNA, 1410 nt, Artificial Sequence
  derived and/or modified sequence opt1 from neuraminidase__InfluenzaA__ADD97038
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaucggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgggggcugguccuggcccgacggcgccgagcugccguucaccaucgacaaguga

SEQ ID NO: 79340 - RNA, 1410 nt, Artificial Sequence; identical to SEQ ID NO: 77746
  derived and/or modified sequence opt1 from neuraminidase__InfluenzaA__ADD97048

SEQ ID NO: 79341 - RNA, 1410 nt, Artificial Sequence; identical to SEQ ID NO: 77746
  derived and/or modified sequence opt1 from neuraminidase__InfluenzaA__ADD97058

SEQ ID NO: 79342 - RNA, 1410 nt, Artificial Sequence; identical to SEQ ID NO: 77746
  derived and/or modified sequence opt1 from neuraminidase__InfluenzaA__ADD97069

SEQ ID NO: 79343 - RNA, 1410 nt, Artificial Sequence; identical to SEQ ID NO: 77746
  derived and/or modified sequence opt1 from neuraminidase__InfluenzaA__ADD97126

SEQ ID NO: 79344 - RNA, 1410 nt, Artificial Sequence; identical to SEQ ID NO: 77746
  derived and/or modified sequence opt1 from neuraminidase__InfluenzaA__ADD97164

SEQ ID NO: 79345 - RNA, 1410 nt, Artificial Sequence; identical to SEQ ID NO: 77746
  derived and/or modified sequence opt1 from neuraminidase__InfluenzaA__ADD97174

SEQ ID NO: 79346 - RNA, 1410 nt, Artificial Sequence; identical to SEQ ID NO: 77746
  derived and/or modified sequence opt1 from neuraminidase__InfluenzaA__ADD97184

SEQ ID NO: 79347 - RNA, 1410 nt, Artificial Sequence
  derived and/or modified sequence opt1 from neuraminidase__InfluenzaA__ADD97194
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacgccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 79348 - RNA, 1410 nt, Artificial Sequence; identical to SEQ ID NO: 79338
  derived and/or modified sequence opt1 from neuraminidase__InfluenzaA__ADD97204

SEQ ID NO: 79349 - RNA, 1410 nt, Artificial Sequence; identical to SEQ ID NO: 77746
  derived and/or modified sequence opt1 from neuraminidase__InfluenzaA__ADD97214

SEQ ID NO: 79350 - RNA, 1410 nt, Artificial Sequence; identical to SEQ ID NO: 77746
  derived and/or modified sequence opt1 from neuraminidase__InfluenzaA__ADD97224

SEQ ID NO: 79351 - RNA, 1410 nt, Artificial Sequence; identical to SEQ ID NO: 77746
  derived and/or modified sequence opt1 from neuraminidase__InfluenzaA__ADD97234

SEQ ID NO: 79352 - RNA, 1410 nt, Artificial Sequence; identical to SEQ ID NO: 77746
  derived and/or modified sequence opt1 from neuraminidase__InfluenzaA__ADD97244

SEQ ID NO: 79353 - RNA, 1410 nt, Artificial Sequence; identical to SEQ ID NO: 77746
  derived and/or modified sequence opt1 from neuraminidase__InfluenzaA__ADD97254

SEQ ID NO: 79354 - RNA, 1410 nt, Artificial Sequence; identical to SEQ ID NO: 77746
  derived and/or modified sequence opt1 from neuraminidase__InfluenzaA__ADD97264

SEQ ID NO: 79355 - RNA, 1410 nt, Artificial Sequence; identical to SEQ ID NO: 77746
  derived and/or modified sequence opt1 from neuraminidase__InfluenzaA__ADD97274

SEQ ID NO: 79356 - RNA, 1410 nt, Artificial Sequence
  derived and/or modified sequence opt1 from neuraminidase__InfluenzaA__ADD97284
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucugcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79357 - RNA, 1410 nt, Artificial Sequence; identical to SEQ ID NO: 77746
  derived and/or modified sequence opt1 from neuraminidase__InfluenzaA__ADD97294

SEQ ID NO: 79358 - RNA, 1410 nt, Artificial Sequence
  derived and/or modified sequence opt1 from neuraminidase__InfluenzaA__ADD97314
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 79359 - RNA, 1410 nt, Artificial Sequence; identical to SEQ ID NO: 77746
  derived and/or modified sequence opt1 from neuraminidase__InfluenzaA__ADD97334

SEQ ID NO: 79360 - RNA, 1410 nt, Artificial Sequence; identical to SEQ ID NO: 77746
  derived and/or modified sequence opt1 from neuraminidase__InfluenzaA__ADD97344

SEQ ID NO: 79361 - RNA, 1410 nt, Artificial Sequence; identical to SEQ ID NO: 77746
  derived and/or modified sequence opt1 from neuraminidase__InfluenzaA__ADD97354

SEQ ID NO: 79362 - RNA, 1410 nt, Artificial Sequence
  derived and/or modified sequence opt1 from neuraminidase__InfluenzaA__ADD97384
augaaccccaaccagaagaucaucaccaucggcagcgugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 79363 - RNA, 1410 nt, Artificial Sequence
  derived and/or modified sequence opt1 from neuraminidase__InfluenzaA__ADD97394
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagccggucgugagcgugaagcuggccgggaacuccagccucugccccgucaacggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgagguccccucccccuacaacagccgguucgaguccguggccuggagcgcgagcgccugccacgacgggaucaacuggcucaccaucggcaucuccggcccggacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaccggcagcugcggccccguguccagcaacggggccaacggcgugaagggguucuccuucaaguacggcaacggggucuggaucggccgcaccaagagcaucuccagccggaacggcuucgagaugaucugggacccgaacggguggaccggcaccgacaacaacuucagcaucaagcaggacaucguggggaucaacgagugguccggcuacagcggguccuucgugcagcaccccgagcugacgggccuggacugcauccgccccugcuucugggucgagcucauccggggccgccccaaggagaacaccaucuggaccagcggguccagcaucuccuucugcggcgugaacagcgacaccgucgggugguccuggccggacggcgccgagcugcccuucacgaucgacaaguga

SEQ ID NO: 79364 - RNA, 1410 nt, Artificial Sequence; identical to SEQ ID NO: 77746
  derived and/or modified sequence opt1 from neuraminidase__InfluenzaA__ADD97404

SEQ ID NO: 79365 - RNA, 1410 nt, Artificial Sequence; identical to SEQ ID NO: 77746
  derived and/or modified sequence opt1 from neuraminidase__InfluenzaA__ADD97424

SEQ ID NO: 79366 - RNA, 1410 nt, Artificial Sequence; identical to SEQ ID NO: 77746
  derived and/or modified sequence opt1 from neuraminidase__InfluenzaA__ADD97434

SEQ ID NO: 79367 - RNA, 1410 nt, Artificial Sequence; identical to SEQ ID NO: 77746
  derived and/or modified sequence opt1 from neuraminidase__InfluenzaA__ADD97444

SEQ ID NO: 79368 - RNA, 1410 nt, Artificial Sequence
  derived and/or modified sequence opt1 from neuraminidase__InfluenzaA__ADD97454
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccgaucagcggcugggccaucuacuccaaggacaacagcauccgcaucggcuccaagggggacgucuucgugauccgggagcccuucaucagcugcagcccccuggagugccgcaccuucuuccugacccagggcgcccuccugagcgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccgugaugaccgacggcccgagcgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 79369 - RNA, 1410 nt, Artificial Sequence
  derived and/or modified sequence opt1 from neuraminidase__InfluenzaA__ADD97464
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcacgaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 79370 - RNA, 1410 nt, Artificial Sequence; identical to SEQ ID NO: 77746
  derived and/or modified sequence opt1 from neuraminidase__InfluenzaA__ADD97474

SEQ ID NO: 79371 - RNA, 1410 nt, Artificial Sequence; identical to SEQ ID NO: 77746
  derived and/or modified sequence opt1 from neuraminidase__InfluenzaA__ADD97484

SEQ ID NO: 79372 - RNA, 1410 nt, Artificial Sequence
  derived and/or modified sequence opt1 from neuraminidase__InfluenzaA__ADD97494
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcucccccagcgagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcugaccaucggcaucagcggccccgacaacggggccguggccguccucaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcucacgggccuggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 79373 - RNA, 1410 nt, Artificial Sequence; identical to SEQ ID NO: 77746
  derived and/or modified sequence opt1 from neuraminidase__InfluenzaA__ADD97504

SEQ ID NO: 79374 - RNA, 1410 nt, Artificial Sequence; identical to SEQ ID NO: 77746
  derived and/or modified sequence opt1 from neuraminidase__InfluenzaA__ADD97514

SEQ ID NO: 79375 - RNA, 1410 nt, Artificial Sequence; identical to SEQ ID NO: 79358
  derived and/or modified sequence opt1 from neuraminidase__InfluenzaA__ADD97534

SEQ ID NO: 79376 - RNA, 1410 nt, Artificial Sequence; identical to SEQ ID NO: 77746
  derived and/or modified sequence opt1 from neuraminidase__InfluenzaA__ADD97544

SEQ ID NO: 79377 - RNA, 1410 nt, Artificial Sequence; identical to SEQ ID NO: 77746
  derived and/or modified sequence opt1 from neuraminidase__InfluenzaA__ADD97554

SEQ ID NO: 79378 - RNA, 1410 nt, Artificial Sequence; identical to SEQ ID NO: 79362
  derived and/or modified sequence opt1 from neuraminidase__InfluenzaA__ADD97564

SEQ ID NO: 79379 - RNA, 1410 nt, Artificial Sequence; identical to SEQ ID NO: 77746
  derived and/or modified sequence opt1 from neuraminidase__InfluenzaA__ADD97574

SEQ ID NO: 79380 - RNA, 1410 nt, Artificial Sequence; identical to SEQ ID NO: 77746
  derived and/or modified sequence opt1 from neuraminidase__InfluenzaA__ADD97584

SEQ ID NO: 79381 - RNA, 1410 nt, Artificial Sequence
  derived and/or modified sequence opt1 from neuraminidase__InfluenzaA__ADD97681
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcaucaacagcgacaccguggggugguccuggcccgacggcgccgagcugccguucacgaucgacaaguga

SEQ ID NO: 79382 - RNA, 1410 nt, Artificial Sequence; identical to SEQ ID NO: 79338
  derived and/or modified sequence opt1 from neuraminidase__InfluenzaA__ADD97691

SEQ ID NO: 79383 - RNA, 1410 nt, Artificial Sequence; identical to SEQ ID NO: 78883
  derived and/or modified sequence opt1 from neuraminidase__InfluenzaA__ADD97701

SEQ ID NO: 79384 - RNA, 1410 nt, Artificial Sequence; identical to SEQ ID NO: 77746
  derived and/or modified sequence opt1 from neuraminidase__InfluenzaA__ADD97891

SEQ ID NO: 79385 - RNA, 1410 nt, Artificial Sequence; identical to SEQ ID NO: 77746
  derived and/or modified sequence opt1 from neuraminidase__InfluenzaA__ADD97901

SEQ ID NO: 79386 - RNA, 1410 nt, Artificial Sequence; identical to SEQ ID NO: 77746
  derived and/or modified sequence opt1 from neuraminidase__InfluenzaA__ADD97911

SEQ ID NO: 79387 - RNA, 1410 nt, Artificial Sequence; identical to SEQ ID NO: 77746
  derived and/or modified sequence opt1 from neuraminidase__InfluenzaA__ADD97921

SEQ ID NO: 79388 - RNA, 1410 nt, Artificial Sequence; identical to SEQ ID NO: 77746
  derived and/or modified sequence opt1 from neuraminidase__InfluenzaA__ADD97931

SEQ ID NO: 79389 - RNA, 1410 nt, Artificial Sequence; identical to SEQ ID NO: 78513
  derived and/or modified sequence opt1 from neuraminidase__InfluenzaA__ADD97941

SEQ ID NO: 79390 - RNA, 1410 nt, Artificial Sequence
  derived and/or modified sequence opt1 from neuraminidase__InfluenzaA__ADD97951
augaaccccaaccagaagaucaucaccaucagcuccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggguccugcggccccgugagcuccaacggcgccaacggggugaagggcuucagcuucaaguacgggaacggcgucuggaucgggcgcaccaagagcaucuccagccggaacggcuucgagaugaucugggaccccaacggcuggaccgggaccgacaacaacuucuccaucaagcaggacaucgugggcaucaacgaguggagcggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggccgagcugccguucacgaucgacaaguga

SEQ ID NO: 79391 - RNA, 1410 nt, Artificial Sequence
  derived and/or modified sequence opt1 from neuraminidase__InfluenzaA__ADD97961
augaaccccaaccagaagaucaucaccaucggcagcgugugcaugaccaucgggauggucaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgccggccagagcgugguguccgucaagcuggcggggaacgccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucccgguucgagagcguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 79392 - RNA, 1410 nt, Artificial Sequence; identical to SEQ ID NO: 79338
  derived and/or modified sequence opt1 from neuraminidase__InfluenzaA__ADD97971

SEQ ID NO: 79393 - RNA, 1410 nt, Artificial Sequence; identical to SEQ ID NO: 77746
  derived and/or modified sequence opt1 from neuraminidase__InfluenzaA__ADD97981

SEQ ID NO: 79394 - RNA, 1410 nt, Artificial Sequence
  derived and/or modified sequence opt1 from neuraminidase__InfluenzaA__ADD97991
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaucggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79395 - RNA, 1410 nt, Artificial Sequence
  derived and/or modified sequence opt1 from neuraminidase__InfluenzaA__ADD98001
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccgugaaguccuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79396 - RNA, 1410 nt, Artificial Sequence; identical to SEQ ID NO: 77746
  derived and/or modified sequence opt1 from neuraminidase__InfluenzaA__ADD98011

SEQ ID NO: 79397 - RNA, 1410 nt, Artificial Sequence; identical to SEQ ID NO: 77746
  derived and/or modified sequence opt1 from neuraminidase__InfluenzaA__ADD98031

SEQ ID NO: 79398 - RNA, 1410 nt, Artificial Sequence; identical to SEQ ID NO: 79395
  derived and/or modified sequence opt1 from neuraminidase__InfluenzaA__ADD98041

SEQ ID NO: 79399 - RNA, 1410 nt, Artificial Sequence; identical to SEQ ID NO: 77746
  derived and/or modified sequence opt1 from neuraminidase__InfluenzaA__ADD98051

SEQ ID NO: 79400 - RNA, 1410 nt, Artificial Sequence; identical to SEQ ID NO: 77746
  derived and/or modified sequence opt1 from neuraminidase__InfluenzaA__ADD98061

SEQ ID NO: 79401 - RNA, 1410 nt, Artificial Sequence; identical to SEQ ID NO: 77746
  derived and/or modified sequence opt1 from neuraminidase__InfluenzaA__ADD98071

SEQ ID NO: 79402 - RNA, 1410 nt, Artificial Sequence; identical to SEQ ID NO: 77746
  derived and/or modified sequence opt1 from neuraminidase__InfluenzaA__ADD98081

SEQ ID NO: 79403 - RNA, 1410 nt, Artificial Sequence; identical to SEQ ID NO: 77746
  derived and/or modified sequence opt1 from neuraminidase__InfluenzaA__ADD98091

SEQ ID NO: 79404 - RNA, 1410 nt, Artificial Sequence; identical to SEQ ID NO: 78572
  derived and/or modified sequence opt1 from neuraminidase__InfluenzaA__ADD98101

SEQ ID NO: 79405 - RNA, 1410 nt, Artificial Sequence
  derived and/or modified sequence opt1 from neuraminidase__InfluenzaA__ADD98111
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcauccugggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79406 - RNA, 1410 nt, Artificial Sequence; identical to SEQ ID NO: 77746
  derived and/or modified sequence opt1 from neuraminidase__InfluenzaA__ADD98121

SEQ ID NO: 79407 - RNA, 1410 nt, Artificial Sequence; identical to SEQ ID NO: 77746
  derived and/or modified sequence opt1 from neuraminidase__InfluenzaA__ADD98131

SEQ ID NO: 79408 - RNA, 1410 nt, Artificial Sequence; identical to SEQ ID NO: 77746
  derived and/or modified sequence opt1 from neuraminidase__InfluenzaA__ADD98141

SEQ ID NO: 79409 - RNA, 1410 nt, Artificial Sequence; identical to SEQ ID NO: 77746
  derived and/or modified sequence opt1 from neuraminidase__InfluenzaA__ADD98151

SEQ ID NO: 79410 - RNA, 1410 nt, Artificial Sequence
  derived and/or modified sequence opt1 from neuraminidase__InfluenzaA__ADD98161
augaaccccaaccagaagaucaucaccaucggcagcgugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggacccgcacggacaacaacuucuccaucaagcaggacaucgugggcaucaacgaguggagcggguacuccggcagcuucgugcagcacccggagcugaccgggcuggacugcauccggcccugcuucugggucgagcucauccgcggccggcccaaggagaacaccaucuggaccuccggcagcuccaucagcuucugcggggugaacuccgacacggucggcuggagcuggcccgacggggccgagcugccguucaccaucgacaaguga

SEQ ID NO: 79411 - RNA, 1410 nt, Artificial Sequence
  derived and/or modified sequence opt1 from neuraminidase__InfluenzaA__ADD98171
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagacggucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcgguccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 79412 - RNA, 1410 nt, Artificial Sequence
  derived and/or modified sequence opt1 from neuraminidase__InfluenzaA__ADD98181
augaaccccaaccagaagaucaucaccaucggcagcgugugcaugaccaucgggauggccaaccugauccuccagaucggcaacaugaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 79413 - RNA, 1410 nt, Artificial Sequence; identical to SEQ ID NO: 77746
  derived and/or modified sequence opt1 from neuraminidase__InfluenzaA__ADD98201

SEQ ID NO: 79414 - RNA, 1410 nt, Artificial Sequence; identical to SEQ ID NO: 77746
  derived and/or modified sequence opt1 from neuraminidase__InfluenzaA__ADD98211

SEQ ID NO: 79415 - RNA, 1410 nt, Artificial Sequence; identical to SEQ ID NO: 78969
  derived and/or modified sequence opt1 from neuraminidase__InfluenzaA__ADE20324

SEQ ID NO: 79416 - RNA, 1410 nt, Artificial Sequence; identical to SEQ ID NO: 78969
  derived and/or modified sequence opt1 from neuraminidase__InfluenzaA__ADE20334

SEQ ID NO: 79417 - RNA, 1410 nt, Artificial Sequence; identical to SEQ ID NO: 78969
  derived and/or modified sequence opt1 from neuraminidase__InfluenzaA__ADE20344

SEQ ID NO: 79418 - RNA, 1410 nt, Artificial Sequence; identical to SEQ ID NO: 78969
  derived and/or modified sequence opt1 from neuraminidase__InfluenzaA__ADE20354

SEQ ID NO: 79419 - RNA, 1410 nt, Artificial Sequence; identical to SEQ ID NO: 78969
  derived and/or modified sequence opt1 from neuraminidase__InfluenzaA__ADE20378

SEQ ID NO: 79420 - RNA, 1410 nt, Artificial Sequence; identical to SEQ ID NO: 78969
  derived and/or modified sequence opt1 from neuraminidase__InfluenzaA__ADE20391

SEQ ID NO: 79421 - RNA, 1410 nt, Artificial Sequence; identical to SEQ ID NO: 78969
  derived and/or modified sequence opt1 from neuraminidase__InfluenzaA__ADE20631

SEQ ID NO: 79422 - RNA, 1410 nt, Artificial Sequence; identical to SEQ ID NO: 78969
  derived and/or modified sequence opt1 from neuraminidase__InfluenzaA__ADE20641

SEQ ID NO: 79423 - RNA, 1410 nt, Artificial Sequence
  derived and/or modified sequence opt1 from neuraminidase__InfluenzaA__ADE20651
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 79424 - RNA, 1410 nt, Artificial Sequence; identical to SEQ ID NO: 78969
  derived and/or modified sequence opt1 from neuraminidase__InfluenzaA__ADE20661

SEQ ID NO: 79425 - RNA, 1410 nt, Artificial Sequence; identical to SEQ ID NO: 78969
  derived and/or modified sequence opt1 from neuraminidase__InfluenzaA__ADE20671

SEQ ID NO: 79426 - RNA, 1410 nt, Artificial Sequence; identical to SEQ ID NO: 78969
  derived and/or modified sequence opt1 from neuraminidase__InfluenzaA__ADE20681

SEQ ID NO: 79427 - RNA, 1410 nt, Artificial Sequence
  derived and/or modified sequence opt1 from neuraminidase__InfluenzaA__ADE20701
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcgugaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 79428 - RNA, 1410 nt, Artificial Sequence; identical to SEQ ID NO: 78969
  derived and/or modified sequence opt1 from neuraminidase__InfluenzaA__ADE20711

SEQ ID NO: 79429 - RNA, 1410 nt, Artificial Sequence
  derived and/or modified sequence opt1 from neuraminidase__InfluenzaA__ADE20721
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgaccgguga

SEQ ID NO: 79430 - RNA, 1410 nt, Artificial Sequence; identical to SEQ ID NO: 79427
  derived and/or modified sequence opt1 from neuraminidase__InfluenzaA__ADE20731

SEQ ID NO: 79431 - RNA, 1410 nt, Artificial Sequence; identical to SEQ ID NO: 78969
  derived and/or modified sequence opt1 from neuraminidase__InfluenzaA__ADE20741

SEQ ID NO: 79432 - RNA, 1410 nt, Artificial Sequence; identical to SEQ ID NO: 78969
  derived and/or modified sequence opt1 from neuraminidase__InfluenzaA__ADE20751

SEQ ID NO: 79433 - RNA, 1410 nt, Artificial Sequence; identical to SEQ ID NO: 79427
  derived and/or modified sequence opt1 from neuraminidase__InfluenzaA__ADE20761

SEQ ID NO: 79434 - RNA, 1410 nt, Artificial Sequence; identical to SEQ ID NO: 79427
  derived and/or modified sequence opt1 from neuraminidase__InfluenzaA__ADE20781

SEQ ID NO: 79435 - RNA, 1410 nt, Artificial Sequence; identical to SEQ ID NO: 77746
  derived and/or modified sequence opt1 from neuraminidase__InfluenzaA__ADE20791

SEQ ID NO: 79436 - RNA, 1410 nt, Artificial Sequence; identical to SEQ ID NO: 77746
  derived and/or modified sequence opt1 from neuraminidase__InfluenzaA__ADE20801

SEQ ID NO: 79437 - RNA, 1410 nt, Artificial Sequence; identical to SEQ ID NO: 77746
  derived and/or modified sequence opt1 from neuraminidase__InfluenzaA__ADE20811

SEQ ID NO: 79438 - RNA, 1410 nt, Artificial Sequence; identical to SEQ ID NO: 77746
  derived and/or modified sequence opt1 from neuraminidase__InfluenzaA__ADE20821

SEQ ID NO: 79439 - RNA, 1410 nt, Artificial Sequence; identical to SEQ ID NO: 77746
  derived and/or modified sequence opt1 from neuraminidase__InfluenzaA__ADE20831

SEQ ID NO: 79440 - RNA, 1410 nt, Artificial Sequence; identical to SEQ ID NO: 77746
  derived and/or modified sequence opt1 from neuraminidase__InfluenzaA__ADE20841

SEQ ID NO: 79441 - RNA, 1410 nt, Artificial Sequence; identical to SEQ ID NO: 77746
  derived and/or modified sequence opt1 from neuraminidase__InfluenzaA__ADE20851

SEQ ID NO: 79442 - RNA, 1410 nt, Artificial Sequence; identical to SEQ ID NO: 79362
  derived and/or modified sequence opt1 from neuraminidase__InfluenzaA__ADE20861

SEQ ID NO: 79443 - RNA, 1410 nt, Artificial Sequence; identical to SEQ ID NO: 77746
  derived and/or modified sequence opt1 from neuraminidase__InfluenzaA__ADE20871

SEQ ID NO: 79444 - RNA, 1410 nt, Artificial Sequence; identical to SEQ ID NO: 79358
  derived and/or modified sequence opt1 from neuraminidase__InfluenzaA__ADE20881

SEQ ID NO: 79445 - RNA, 1410 nt, Artificial Sequence; identical to SEQ ID NO: 77746
  derived and/or modified sequence opt1 from neuraminidase__InfluenzaA__ADE20891

SEQ ID NO: 79446 - RNA, 1410 nt, Artificial Sequence; identical to SEQ ID NO: 77746
  derived and/or modified sequence opt1 from neuraminidase__InfluenzaA__ADE20901

SEQ ID NO: 79447 - RNA, 1410 nt, Artificial Sequence; identical to SEQ ID NO: 77746
  derived and/or modified sequence opt1 from neuraminidase__InfluenzaA__ADE20911

SEQ ID NO: 79448 - RNA, 1410 nt, Artificial Sequence; identical to SEQ ID NO: 77746
  derived and/or modified sequence opt1 from neuraminidase__InfluenzaA__ADE20921

SEQ ID NO: 79449 - RNA, 1410 nt, Artificial Sequence
  derived and/or modified sequence opt1 from neuraminidase__InfluenzaA__ADE20931
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucggcagccggaacggguucgagaugaucugggaccccaacggcuggaccgggaccgacaacaacuucagcaucaagcaggacaucgugggcaucaacgagugguccggguacagcggcuccuucgugcagcacccggagcugacgggccucgacugcauccgccccugcuucugggucgagcugauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 79450 - RNA, 1410 nt, Artificial Sequence; identical to SEQ ID NO: 77746
  derived and/or modified sequence opt1 from neuraminidase__InfluenzaA__ADE20941

SEQ ID NO: 79451 - RNA, 1410 nt, Artificial Sequence
  derived and/or modified sequence opt1 from neuraminidase__InfluenzaA__ADE20951
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacgugguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79452 - RNA, 1410 nt, Artificial Sequence
  derived and/or modified sequence opt1 from neuraminidase__InfluenzaA__ADE20961
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacgacaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 79453 - RNA, 1410 nt, Artificial Sequence; identical to SEQ ID NO: 77746
  derived and/or modified sequence opt1 from neuraminidase__InfluenzaA__ADE20971

SEQ ID NO: 79454 - RNA, 1410 nt, Artificial Sequence; identical to SEQ ID NO: 79362
  derived and/or modified sequence opt1 from neuraminidase__InfluenzaA__ADE20981

SEQ ID NO: 79455 - RNA, 1410 nt, Artificial Sequence; identical to SEQ ID NO: 77746
  derived and/or modified sequence opt1 from neuraminidase__InfluenzaA__ADE20991

SEQ ID NO: 79456 - RNA, 1410 nt, Artificial Sequence
  derived and/or modified sequence opt1 from neuraminidase__InfluenzaA__ADE21001
augaaccccaaccagaagaucaucaccaucggcagcgugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucaucauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgaggugcccagccccuacaacucccgguucgagagcgucgccuggagcgcguccgccugccacgacgggaucaacuggcucaccaucggcaucagcggccccgacaacggggccguggccgugcugaaguacaacggcaucaucaccgacacgaucaaguccuggcgcaacaacauccugcggacccaggagagcgagugcgcgugcgucaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 79457 - RNA, 1410 nt, Artificial Sequence; identical to SEQ ID NO: 77746
  derived and/or modified sequence opt1 from neuraminidase__InfluenzaA__ADE21011

SEQ ID NO: 79458 - RNA, 1410 nt, Artificial Sequence; identical to SEQ ID NO: 77746
  derived and/or modified sequence opt1 from neuraminidase__InfluenzaA__ADE21021

SEQ ID NO: 79459 - RNA, 1410 nt, Artificial Sequence; identical to SEQ ID NO: 79395
  derived and/or modified sequence opt1 from neuraminidase__InfluenzaA__ADE21031

SEQ ID NO: 79460 - RNA, 1410 nt, Artificial Sequence
  derived and/or modified sequence opt1 from neuraminidase__InfluenzaA__ADE21041
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccaucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79461 - RNA, 1410 nt, Artificial Sequence; identical to SEQ ID NO: 77746
  derived and/or modified sequence opt1 from neuraminidase__InfluenzaA__ADE21051

SEQ ID NO: 79462 - RNA, 1410 nt, Artificial Sequence
  derived and/or modified sequence opt1 from neuraminidase__InfluenzaA__ADE21071
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaaguucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79463 - RNA, 1413 nt, Artificial Sequence; identical to SEQ ID NO: 77640
  derived and/or modified sequence opt1 from neuraminidase__InfluenzaA__ADE28752

SEQ ID NO: 79464 - RNA, 1413 nt, Artificial Sequence; identical to SEQ ID NO: 78469
  derived and/or modified sequence opt1 from neuraminidase__InfluenzaA__ADE28763

SEQ ID NO: 79465 - RNA, 1410 nt, Artificial Sequence; identical to SEQ ID NO: 78969
  derived and/or modified sequence opt1 from neuraminidase__InfluenzaA__ADE28773

SEQ ID NO: 79466 - RNA, 1410 nt, Artificial Sequence; identical to SEQ ID NO: 78969
  derived and/or modified sequence opt1 from neuraminidase__InfluenzaA__ADE28783

SEQ ID NO: 79467 - RNA, 1410 nt, Artificial Sequence; identical to SEQ ID NO: 79427
  derived and/or modified sequence opt1 from neuraminidase__InfluenzaA__ADE28803

SEQ ID NO: 79468 - RNA, 1410 nt, Artificial Sequence; identical to SEQ ID NO: 77746
  derived and/or modified sequence opt1 from neuraminidase__InfluenzaA__ADE28813

SEQ ID NO: 79469 - RNA, 1410 nt, Artificial Sequence; identical to SEQ ID NO: 77746
  derived and/or modified sequence opt1 from neuraminidase__InfluenzaA__ADE28823

SEQ ID NO: 79470 - RNA, 1410 nt, Artificial Sequence
  derived and/or modified sequence opt1 from neuraminidase__InfluenzaA__ADE28843
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccggugggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 79471 - RNA, 1410 nt, Artificial Sequence
  derived and/or modified sequence opt1 from neuraminidase__InfluenzaA__ADE28853
augaaccccaaccagaagaucaucaccaucgugagcgucugcaugaccaucggcauggccaaccugauccuccagaucgggaacaucaucuccaucuggaucagccacuccauccagcugggcaaccagaaccagaucgagacgugcaaccagagcgugaucaccuacgagaacaacaccugggugaaccagaccuacgucaacaucuccaacacgaacuucgccgcggggcagagcgugguguccgucaagcuggccggcaacagcucccucugcccggugagcgggugggccaucuacuccaaggacaacagcgugcgcaucggcuccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgagcgccugccacgacggcaucaacuggcucaccaucgggaucuccggccccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacgggccguccaacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgugggcugguccuggcccgacggggccgagcugccguucacgaucgacaaguga

SEQ ID NO: 79472 - RNA, 1410 nt, Artificial Sequence; identical to SEQ ID NO: 79470
  derived and/or modified sequence opt1 from neuraminidase__InfluenzaA__ADE28884

SEQ ID NO: 79473 - RNA, 1410 nt, Artificial Sequence
  derived and/or modified sequence opt1 from neuraminidase__InfluenzaA__ADE28894
augaaccccaaccagaagaucaucaccaucggcagcgugugcaugaccaucgggauggccaaccugauccuccagaucggcaacaucaucuccaucuggaucagccacuccguccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 79474 - RNA, 1410 nt, Artificial Sequence; identical to SEQ ID NO: 79394
  derived and/or modified sequence opt1 from neuraminidase__InfluenzaA__ADE28904

SEQ ID NO: 79475 - RNA, 1410 nt, Artificial Sequence; identical to SEQ ID NO: 77746
  derived and/or modified sequence opt1 from neuraminidase__InfluenzaA__ADE28914

SEQ ID NO: 79476 - RNA, 1410 nt, Artificial Sequence; identical to SEQ ID NO: 77746
  derived and/or modified sequence opt1 from neuraminidase__InfluenzaA__ADE28924

SEQ ID NO: 79477 - RNA, 1410 nt, Artificial Sequence
  derived and/or modified sequence opt1 from neuraminidase__InfluenzaA__ADE28934
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcaucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79478 - RNA, 1410 nt, Artificial Sequence; identical to SEQ ID NO: 77746
  derived and/or modified sequence opt1 from neuraminidase__InfluenzaA__ADE28954

SEQ ID NO: 79479 - RNA, 1410 nt, Artificial Sequence
  derived and/or modified sequence opt1 from neuraminidase__InfluenzaA__ADE28964
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacaucaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79480 - RNA, 1410 nt, Artificial Sequence; identical to SEQ ID NO: 77746
  derived and/or modified sequence opt1 from neuraminidase__InfluenzaA__ADE28974

SEQ ID NO: 79481 - RNA, 1410 nt, Artificial Sequence
  derived and/or modified sequence opt1 from neuraminidase__InfluenzaA__ADE29004
augaaccccaaccagaagaucaucaccaucggcagcgugugcaugaccaucgggcuggccaaccucauccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcgugcgcaucggcuccaagggggacguguucgucauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgaggugcccucccccuacaacagccgguucgagagcguggccugguccgcgagcgccugccacgacgggaucaacuggcugaccaucggcaucuccggccccgacaacggggccgucgccgugcugaaguacaacggcaucaucaccgacaccaucaagagcuggcgcaacaacauccuccggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaagaacuucagcaucaagcaggacaucguggggaucaacgagugguccggcuacagcggguccuucguccagcacccggagcugacgggccucgacugcauccggcccugcuucuggguggagcugauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 79482 - RNA, 1410 nt, Artificial Sequence; identical to SEQ ID NO: 77746
  derived and/or modified sequence opt1 from neuraminidase__InfluenzaA__ADE29014

SEQ ID NO: 79483 - RNA, 1410 nt, Artificial Sequence
  derived and/or modified sequence opt1 from neuraminidase__InfluenzaA__ADE29024
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaacggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgccgagcugccguucaccaucgacaaguga

SEQ ID NO: 79484 - RNA, 1410 nt, Artificial Sequence; identical to SEQ ID NO: 77746
  derived and/or modified sequence opt1 from neuraminidase__InfluenzaA__ADE29034

SEQ ID NO: 79485 - RNA, 1410 nt, Artificial Sequence; identical to SEQ ID NO: 77746
  derived and/or modified sequence opt1 from neuraminidase__InfluenzaA__ADE29044

SEQ ID NO: 79486 - RNA, 1410 nt, Artificial Sequence; identical to SEQ ID NO: 77746
  derived and/or modified sequence opt1 from neuraminidase__InfluenzaA__ADE29054

SEQ ID NO: 79487 - RNA, 1410 nt, Artificial Sequence; identical to SEQ ID NO: 79034
  derived and/or modified sequence opt1 from neuraminidase__InfluenzaA__ADE29064

SEQ ID NO: 79488 - RNA, 1410 nt, Artificial Sequence
  derived and/or modified sequence opt1 from neuraminidase__InfluenzaA__ADE29087
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugcaagaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggagcugcuucaccgucaugaccgacggcccguccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 79489 - RNA, 1410 nt, Artificial Sequence; identical to SEQ ID NO: 77736
  derived and/or modified sequence opt1 from neuraminidase__InfluenzaA__ADE29097

SEQ ID NO: 79490 - RNA, 1410 nt, Artificial Sequence; identical to SEQ ID NO: 78613
  derived and/or modified sequence opt1 from neuraminidase__InfluenzaA__ADE34194

SEQ ID NO: 79491 - RNA, 1410 nt, Artificial Sequence; identical to SEQ ID NO: 77607
  derived and/or modified sequence opt1 from neuraminidase__InfluenzaA__ADE34205

SEQ ID NO: 79492 - RNA, 1410 nt, Artificial Sequence
  derived and/or modified sequence opt1 from neuraminidase__InfluenzaA__ADE34216
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 79493 - RNA, 1410 nt, Artificial Sequence; identical to SEQ ID NO: 78613
  derived and/or modified sequence opt1 from neuraminidase__InfluenzaA__ADE34227

SEQ ID NO: 79494 - RNA, 1410 nt, Artificial Sequence; identical to SEQ ID NO: 78613
  derived and/or modified sequence opt1 from neuraminidase__InfluenzaA__ADE34238

SEQ ID NO: 79495 - RNA, 1410 nt, Artificial Sequence
  derived and/or modified sequence opt1 from neuraminidase__InfluenzaA__ADE34260
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugauguccaucuga

SEQ ID NO: 79496 - RNA, 1410 nt, Artificial Sequence; identical to SEQ ID NO: 78613
  derived and/or modified sequence opt1 from neuraminidase__InfluenzaA__ADE34271

SEQ ID NO: 79497 - RNA, 1410 nt, Artificial Sequence; identical to SEQ ID NO: 77746
  derived and/or modified sequence opt1 from neuraminidase__InfluenzaA__ADE45502

SEQ ID NO: 79498 - RNA, 1410 nt, Artificial Sequence; identical to SEQ ID NO: 77746
  derived and/or modified sequence opt1 from neuraminidase__InfluenzaA__ADE45504

SEQ ID NO: 79499 - RNA, 1410 nt, Artificial Sequence; identical to SEQ ID NO: 77746
  derived and/or modified sequence opt1 from neuraminidase__InfluenzaA__ADE45506

SEQ ID NO: 79500 - RNA, 1410 nt, Artificial Sequence; identical to SEQ ID NO: 77746
  derived and/or modified sequence opt1 from neuraminidase__InfluenzaA__ADE45508

SEQ ID NO: 79501 - RNA, 1410 nt, Artificial Sequence; identical to SEQ ID NO: 77746
  derived and/or modified sequence opt1 from neuraminidase__InfluenzaA__ADE45510

SEQ ID NO: 79502 - RNA, 1410 nt, Artificial Sequence; identical to SEQ ID NO: 77746
  derived and/or modified sequence opt1 from neuraminidase__InfluenzaA__ADE45512

SEQ ID NO: 79503 - RNA, 1410 nt, Artificial Sequence
  derived and/or modified sequence opt1 from neuraminidase__InfluenzaA__ADE45514
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuuccaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79504 - RNA, 1410 nt, Artificial Sequence
  derived and/or modified sequence opt1 from neuraminidase__InfluenzaA__ADE45516
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagccugcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79505 - RNA, 1410 nt, Artificial Sequence
  derived and/or modified sequence opt1 from neuraminidase__InfluenzaA__ADF10069
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcacccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 79506 - RNA, 1410 nt, Artificial Sequence; identical to SEQ ID NO: 77746
  derived and/or modified sequence opt1 from neuraminidase__InfluenzaA__ADF10079

SEQ ID NO: 79507 - RNA, 1410 nt, Artificial Sequence; identical to SEQ ID NO: 77746
  derived and/or modified sequence opt1 from neuraminidase__InfluenzaA__ADF10089

SEQ ID NO: 79508 - RNA, 1410 nt, Artificial Sequence; identical to SEQ ID NO: 77746
  derived and/or modified sequence opt1 from neuraminidase__InfluenzaA__ADF10099

SEQ ID NO: 79509 - RNA, 1410 nt, Artificial Sequence
  derived and/or modified sequence opt1 from neuraminidase__InfluenzaA__ADF10109
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcaacugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79510 - RNA, 1410 nt, Artificial Sequence; identical to SEQ ID NO: 77746
  derived and/or modified sequence opt1 from neuraminidase__InfluenzaA__ADF10129

SEQ ID NO: 79511 - RNA, 1410 nt, Artificial Sequence; identical to SEQ ID NO: 79176
  derived and/or modified sequence opt1 from neuraminidase__InfluenzaA__ADF10146

SEQ ID NO: 79512 - RNA, 1410 nt, Artificial Sequence
  derived and/or modified sequence opt1 from neuraminidase__InfluenzaA__ADF10166
augaaccccaaccagaagaucaucaccaucggcagcgugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79513 - RNA, 1410 nt, Artificial Sequence; identical to SEQ ID NO: 79512
  derived and/or modified sequence opt1 from neuraminidase__InfluenzaA__ADF10176

SEQ ID NO: 79514 - RNA, 1410 nt, Artificial Sequence; identical to SEQ ID NO: 79512
  derived and/or modified sequence opt1 from neuraminidase__InfluenzaA__ADF10192

SEQ ID NO: 79515 - RNA, 1410 nt, Artificial Sequence; identical to SEQ ID NO: 77746
  derived and/or modified sequence opt1 from neuraminidase__InfluenzaA__ADF10247

SEQ ID NO: 79516 - RNA, 1410 nt, Artificial Sequence; identical to SEQ ID NO: 79512
  derived and/or modified sequence opt1 from neuraminidase__InfluenzaA__ADF10290

SEQ ID NO: 79517 - RNA, 1410 nt, Artificial Sequence
  derived and/or modified sequence opt1 from neuraminidase__InfluenzaA__ADF10304
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccggccugccguucacgaucgacaaguga

SEQ ID NO: 79518 - RNA, 1410 nt, Artificial Sequence; identical to SEQ ID NO: 77746
  derived and/or modified sequence opt1 from neuraminidase__InfluenzaA__ADF10340

SEQ ID NO: 79519 - RNA, 1410 nt, Artificial Sequence; identical to SEQ ID NO: 77746
  derived and/or modified sequence opt1 from neuraminidase__InfluenzaA__ADF10361

SEQ ID NO: 79520 - RNA, 1410 nt, Artificial Sequence; identical to SEQ ID NO: 79512
  derived and/or modified sequence opt1 from neuraminidase__InfluenzaA__ADF10371

SEQ ID NO: 79521 - RNA, 1410 nt, Artificial Sequence; identical to SEQ ID NO: 79512
  derived and/or modified sequence opt1 from neuraminidase__InfluenzaA__ADF10407

SEQ ID NO: 79522 - RNA, 1410 nt, Artificial Sequence; identical to SEQ ID NO: 77746
  derived and/or modified sequence opt1 from neuraminidase__InfluenzaA__ADF10472

SEQ ID NO: 79523 - RNA, 1410 nt, Artificial Sequence; identical to SEQ ID NO: 79512
  derived and/or modified sequence opt1 from neuraminidase__InfluenzaA__ADF10616

SEQ ID NO: 79524 - RNA, 1410 nt, Artificial Sequence; identical to SEQ ID NO: 79512
  derived and/or modified sequence opt1 from neuraminidase__InfluenzaA__ADF10688

SEQ ID NO: 79525 - RNA, 1410 nt, Artificial Sequence; identical to SEQ ID NO: 79512
  derived and/or modified sequence opt1 from neuraminidase__InfluenzaA__ADF10726

SEQ ID NO: 79526 - RNA, 1410 nt, Artificial Sequence; identical to SEQ ID NO: 77746
  derived and/or modified sequence opt1 from neuraminidase__InfluenzaA__ADF10773

SEQ ID NO: 79527 - RNA, 1410 nt, Artificial Sequence
  derived and/or modified sequence opt1 from neuraminidase__InfluenzaA__ADF10837
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 79528 - RNA, 1410 nt, Artificial Sequence; identical to SEQ ID NO: 77746
  derived and/or modified sequence opt1 from neuraminidase__InfluenzaA__ADF10889

SEQ ID NO: 79529 - RNA, 1410 nt, Artificial Sequence; identical to SEQ ID NO: 77746
  derived and/or modified sequence opt1 from neuraminidase__InfluenzaA__ADF10947

SEQ ID NO: 79530 - RNA, 1410 nt, Artificial Sequence; identical to SEQ ID NO: 77746
  derived and/or modified sequence opt1 from neuraminidase__InfluenzaA__ADF11010

SEQ ID NO: 79531 - RNA, 1410 nt, Artificial Sequence
  derived and/or modified sequence opt1 from neuraminidase__InfluenzaA__ADF27355
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaugggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79532 - RNA, 1410 nt, Artificial Sequence
  derived and/or modified sequence opt1 from neuraminidase__InfluenzaA__ADF27356
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagaacgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuacuacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79533 - RNA, 1410 nt, Artificial Sequence; identical to SEQ ID NO: 78100
  derived and/or modified sequence opt1 from neuraminidase__InfluenzaA__ADF27357

SEQ ID NO: 79534 - RNA, 1410 nt, Artificial Sequence; identical to SEQ ID NO: 78100
  derived and/or modified sequence opt1 from neuraminidase__InfluenzaA__ADF27358

SEQ ID NO: 79535 - RNA, 1410 nt, Artificial Sequence; identical to SEQ ID NO: 78100
  derived and/or modified sequence opt1 from neuraminidase__InfluenzaA__ADF27360

SEQ ID NO: 79536 - RNA, 1410 nt, Artificial Sequence; identical to SEQ ID NO: 77746
  derived and/or modified sequence opt1 from neuraminidase__InfluenzaA__ADF27361

SEQ ID NO: 79537 - RNA, 1410 nt, Artificial Sequence; identical to SEQ ID NO: 77746
  derived and/or modified sequence opt1 from neuraminidase__InfluenzaA__ADF27362

SEQ ID NO: 79538 - RNA, 1410 nt, Artificial Sequence; identical to SEQ ID NO: 77746
  derived and/or modified sequence opt1 from neuraminidase__InfluenzaA__ADF27363

SEQ ID NO: 79539 - RNA, 1410 nt, Artificial Sequence; identical to SEQ ID NO: 78100
  derived and/or modified sequence opt1 from neuraminidase__InfluenzaA__ADF27364

SEQ ID NO: 79540 - RNA, 1410 nt, Artificial Sequence; identical to SEQ ID NO: 77746
  derived and/or modified sequence opt1 from neuraminidase__InfluenzaA__ADF27365

SEQ ID NO: 79541 - RNA, 1410 nt, Artificial Sequence; identical to SEQ ID NO: 78100
  derived and/or modified sequence opt1 from neuraminidase__InfluenzaA__ADF27366

SEQ ID NO: 79542 - RNA, 1410 nt, Artificial Sequence; identical to SEQ ID NO: 77746
  derived and/or modified sequence opt1 from neuraminidase__InfluenzaA__ADF27382

SEQ ID NO: 79543 - RNA, 1410 nt, Artificial Sequence; identical to SEQ ID NO: 77746
  derived and/or modified sequence opt1 from neuraminidase__InfluenzaA__ADF27392

SEQ ID NO: 79544 - RNA, 1410 nt, Artificial Sequence; identical to SEQ ID NO: 77746
  derived and/or modified sequence opt1 from neuraminidase__InfluenzaA__ADF27402

SEQ ID NO: 79545 - RNA, 1410 nt, Artificial Sequence; identical to SEQ ID NO: 79527
  derived and/or modified sequence opt1 from neuraminidase__InfluenzaA__ADF27422

SEQ ID NO: 79546 - RNA, 1410 nt, Artificial Sequence
  derived and/or modified sequence opt1 from neuraminidase__InfluenzaA__ADF27432
augaaccccaaccagaagaucaucaccaucggcagcgugugcgucaccaucgggauggccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79547 - RNA, 1410 nt, Artificial Sequence
  derived and/or modified sequence opt1 from neuraminidase__InfluenzaA__ADF27442
augaaccccaaccagaagaucaucaccaucggcagcgugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 79548 - RNA, 1410 nt, Artificial Sequence
  derived and/or modified sequence opt1 from neuraminidase__InfluenzaA__ADF27462
augaaccccaaccagaagaucaucaccaucggcagcgugugcaugaccaucgggauggccaaccugauccuccagaucggcaacaucaucuccaucuggaucagccacuccauccagcuggggaaccagaaccagaucgaggccugcaaccagagcgucaucacguacgagaacaacaccugggugaaccagaccuacgugaacaucuccaacaccaacuucgcggccggccagagcgucguguccgugaagcuggccgggaacagcucccucugcccggucagcggcugggccguguacuccaaggacaacagcauccgcaucggcuccaagggggacguguucgucauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagagcguggcgugguccgccagcgccugccacgacgggaucaacuggcucacgaucggcaucuccggccccgacaacggggccgucgcggugcugaaguacaacggcaucaucaccgacaccaucaagagcuggcgcaacaacauccugcggacccaggaguccgagugcgccugcgugaacgggagcugcuucacggucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgcggagcugccguucaccaucgacaaguga

SEQ ID NO: 79549 - RNA, 1410 nt, Artificial Sequence; identical to SEQ ID NO: 77746
  derived and/or modified sequence opt1 from neuraminidase__InfluenzaA__ADF27472

SEQ ID NO: 79550 - RNA, 1410 nt, Artificial Sequence
  derived and/or modified sequence opt1 from neuraminidase__InfluenzaA__ADF27482
augaaccccaaccagaagaucaucaccaucggcagcgugugcaugaccaucgggauggccaaccugauccuccagaucggcaacaucaucuccaucuggaucagccacuccauccagcuggggaaccagaaccaggucgagacgugcaaccagagcaucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79551 - RNA, 1410 nt, Artificial Sequence
  derived and/or modified sequence opt1 from neuraminidase__InfluenzaA__ADF27492
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagccgugcaaccagagcgucaucacguacgagaacaacaccugggugaaccagaccuacgugaacaucuccaacaccaacuucgccgcgggccagagcgucguguccgugaagcuggccgggaacagcucccucugccccgucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccgguccccguaccgcacccugaugagcugccccaucggcgagguccccucccccuacaacagccgguucgagagcguggccugguccgcgagcgccugccacgacgggaucaacuggcucacgaucggcaucuccggcccggacaacggggccguggccguccugaaguacaacggcaucaucaccgacaccaucaagagcuggcgcaacaacauccugcggacccaggaguccgagugcgcgugcgugaacgggagcugcuucacggugaugaccgacggccccuccgacggccaggccagcuacaagaucuuccgcaucgagaaggggaagaucgucaaguccaucgagaugaacgcccccaacuaccacuacgaggagugcagcugcuaccccgacuccagcgagaucacgugcgugugccgggacaacuggcacggcuccaaccgcccgugggugagcuucaaccagaaccucgaguaccagaucggguacaucugcuccggcaucuucggggacaacccccggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggacccgaacggguggaccggcaccgacaacaacuucagcaucaagcaggacaucgucgggaucaacgagugguccggcuacagcggguccuucgugcagcaccccgagcugaccggccuggacugcauccgccccugcuucuggguggagcucauccggggccgccccaaggagaacacggucuggaccagcggguccagcaucuccuucugcggcgugaacagcgacaccgucgggugguccuggccggacggcgccgagcugcccuucaccaucgacaaguga

SEQ ID NO: 79552 - RNA, 1410 nt, Artificial Sequence; identical to SEQ ID NO: 77746
  derived and/or modified sequence opt1 from neuraminidase__InfluenzaA__ADF27502

SEQ ID NO: 79553 - RNA, 1410 nt, Artificial Sequence; identical to SEQ ID NO: 77746
  derived and/or modified sequence opt1 from neuraminidase__InfluenzaA__ADF27512

SEQ ID NO: 79554 - RNA, 1410 nt, Artificial Sequence
  derived and/or modified sequence opt1 from neuraminidase__InfluenzaA__ADF27522
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaucaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79555 - RNA, 1410 nt, Artificial Sequence; identical to SEQ ID NO: 77746
  derived and/or modified sequence opt1 from neuraminidase__InfluenzaA__ADF27532

SEQ ID NO: 79556 - RNA, 1410 nt, Artificial Sequence
  derived and/or modified sequence opt1 from neuraminidase__InfluenzaA__ADF27542
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 79557 - RNA, 1410 nt, Artificial Sequence
  derived and/or modified sequence opt1 from neuraminidase__InfluenzaA__ADF27552
augaaccccaaccagaagaucaucaccaucggcagcgugugcaugaccaucgggcuggccaaccucauccugcagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcucgccgggaacagcucccugugcccggugagcggcugggccaucuacuccaaggacaacagcgugcgcaucggcuccaagggggacgucuucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgaggugcccucccccuacaacagccgguucgagagcgucgccugguccgcgagcgccugccacgacgggaucaacuggcugaccaucggcaucuccggccccgacaacggggccguggccgugcugaaguacaacggcaucaucaccgacaccaucaagagcuggcgcaacaacauccuccggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccggaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaagaacuucagcaucaagcaggacaucgucgggaucaacgagugguccggcuacagcggguccuucgugcagcacccggagcugacgggccucgacugcauccggcccugcuucugggucgagcugauccgcggccggcccaaggagaacaccaucuggaccagcggguccagcaucuccuucugcggcgugaacagcgacaccguggggugguccuggcccgacggcgccgagcugccguucacgaucgacaaguga

SEQ ID NO: 79558 - RNA, 1410 nt, Artificial Sequence; identical to SEQ ID NO: 78572
  derived and/or modified sequence opt1 from neuraminidase__InfluenzaA__ADF27562

SEQ ID NO: 79559 - RNA, 1410 nt, Artificial Sequence; identical to SEQ ID NO: 77746
  derived and/or modified sequence opt1 from neuraminidase__InfluenzaA__ADF27572

SEQ ID NO: 79560 - RNA, 1410 nt, Artificial Sequence
  derived and/or modified sequence opt1 from neuraminidase__InfluenzaA__ADF27582
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 79561 - RNA, 1410 nt, Artificial Sequence; identical to SEQ ID NO: 77746
  derived and/or modified sequence opt1 from neuraminidase__InfluenzaA__ADF27592

SEQ ID NO: 79562 - RNA, 1410 nt, Artificial Sequence
  derived and/or modified sequence opt1 from neuraminidase__InfluenzaA__ADF27602
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagcgggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacagcuucuccaucaagcaggacaucguggggaucaacgaguggagcggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 79563 - RNA, 1410 nt, Artificial Sequence; identical to SEQ ID NO: 77746
  derived and/or modified sequence opt1 from neuraminidase__InfluenzaA__ADF27612

SEQ ID NO: 79564 - RNA, 1410 nt, Artificial Sequence; identical to SEQ ID NO: 79034
  derived and/or modified sequence opt1 from neuraminidase__InfluenzaA__ADF27622

SEQ ID NO: 79565 - RNA, 1410 nt, Artificial Sequence; identical to SEQ ID NO: 79481
  derived and/or modified sequence opt1 from neuraminidase__InfluenzaA__ADF27632

SEQ ID NO: 79566 - RNA, 1410 nt, Artificial Sequence; identical to SEQ ID NO: 77746
  derived and/or modified sequence opt1 from neuraminidase__InfluenzaA__ADF27642

SEQ ID NO: 79567 - RNA, 1410 nt, Artificial Sequence; identical to SEQ ID NO: 77746
  derived and/or modified sequence opt1 from neuraminidase__InfluenzaA__ADF27652

SEQ ID NO: 79568 - RNA, 1410 nt, Artificial Sequence
  derived and/or modified sequence opt1 from neuraminidase__InfluenzaA__ADF27662
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugcaacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 79569 - RNA, 1410 nt, Artificial Sequence; identical to SEQ ID NO: 77746
  derived and/or modified sequence opt1 from neuraminidase__InfluenzaA__ADF27672

SEQ ID NO: 79570 - RNA, 1410 nt, Artificial Sequence; identical to SEQ ID NO: 77746
  derived and/or modified sequence opt1 from neuraminidase__InfluenzaA__ADF27682

SEQ ID NO: 79571 - RNA, 1410 nt, Artificial Sequence; identical to SEQ ID NO: 77746
  derived and/or modified sequence opt1 from neuraminidase__InfluenzaA__ADF27692

SEQ ID NO: 79572 - RNA, 1410 nt, Artificial Sequence; identical to SEQ ID NO: 77746
  derived and/or modified sequence opt1 from neuraminidase__InfluenzaA__ADF27702

SEQ ID NO: 79573 - RNA, 1410 nt, Artificial Sequence; identical to SEQ ID NO: 77746
  derived and/or modified sequence opt1 from neuraminidase__InfluenzaA__ADF27712

SEQ ID NO: 79574 - RNA, 1410 nt, Artificial Sequence; identical to SEQ ID NO: 79034
  derived and/or modified sequence opt1 from neuraminidase__InfluenzaA__ADF27788

SEQ ID NO: 79575 - RNA, 1410 nt, Artificial Sequence; identical to SEQ ID NO: 78989
  derived and/or modified sequence opt1 from neuraminidase__InfluenzaA__ADF27798

SEQ ID NO: 79576 - RNA, 1410 nt, Artificial Sequence; identical to SEQ ID NO: 79481
  derived and/or modified sequence opt1 from neuraminidase__InfluenzaA__ADF27808

SEQ ID NO: 79577 - RNA, 1410 nt, Artificial Sequence
  derived and/or modified sequence opt1 from neuraminidase__InfluenzaA__ADF27818
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucaacagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 79578 - RNA, 1410 nt, Artificial Sequence; identical to SEQ ID NO: 77746
  derived and/or modified sequence opt1 from neuraminidase__InfluenzaA__ADF27838

SEQ ID NO: 79579 - RNA, 1410 nt, Artificial Sequence; identical to SEQ ID NO: 77746
  derived and/or modified sequence opt1 from neuraminidase__InfluenzaA__ADF27848

SEQ ID NO: 79580 - RNA, 1410 nt, Artificial Sequence
  derived and/or modified sequence opt1 from neuraminidase__InfluenzaA__ADF27858
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccagcuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgccugcgugaacggguccugcuucaccgugaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacggggacaccgucggcugguccuggcccgacggcgccgagcugccguucaccaucgacaaguga

SEQ ID NO: 79581 - RNA, 1410 nt, Artificial Sequence
  derived and/or modified sequence opt1 from neuraminidase__InfluenzaA__ADF27878
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacggggacaccgucggcuggagcuggcccgacggcgccgagcugccguucaccaucgacaaguga

SEQ ID NO: 79582 - RNA, 1410 nt, Artificial Sequence; identical to SEQ ID NO: 79034
  derived and/or modified sequence opt1 from neuraminidase__InfluenzaA__ADF27888

SEQ ID NO: 79583 - RNA, 1410 nt, Artificial Sequence; identical to SEQ ID NO: 77746
  derived and/or modified sequence opt1 from neuraminidase__InfluenzaA__ADF27898

SEQ ID NO: 79584 - RNA, 1410 nt, Artificial Sequence; identical to SEQ ID NO: 79034
  derived and/or modified sequence opt1 from neuraminidase__InfluenzaA__ADF27908

SEQ ID NO: 79585 - RNA, 1410 nt, Artificial Sequence; identical to SEQ ID NO: 79034
  derived and/or modified sequence opt1 from neuraminidase__InfluenzaA__ADF27918

SEQ ID NO: 79586 - RNA, 1410 nt, Artificial Sequence
  derived and/or modified sequence opt1 from neuraminidase__InfluenzaA__ADF27938
augaaccccaaccagcgcaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcauguccuucugcggcgugaacagcgacaccgucgggugguccuggcccgacggcgccgagcugccguucacgaucgacaaguga

SEQ ID NO: 79587 - RNA, 1410 nt, Artificial Sequence; identical to SEQ ID NO: 77746
  derived and/or modified sequence opt1 from neuraminidase__InfluenzaA__ADF27948

SEQ ID NO: 79588 - RNA, 1410 nt, Artificial Sequence; identical to SEQ ID NO: 79034
  derived and/or modified sequence opt1 from neuraminidase__InfluenzaA__ADF27958

SEQ ID NO: 79589 - RNA, 1410 nt, Artificial Sequence; identical to SEQ ID NO: 77746
  derived and/or modified sequence opt1 from neuraminidase__InfluenzaA__ADF27968

SEQ ID NO: 79590 - RNA, 1410 nt, Artificial Sequence; identical to SEQ ID NO: 79034
  derived and/or modified sequence opt1 from neuraminidase__InfluenzaA__ADF27978

SEQ ID NO: 79591 - RNA, 1410 nt, Artificial Sequence
  derived and/or modified sequence opt1 from neuraminidase__InfluenzaA__ADF27988
augaaccccaaccagaagaucaucaccaucggcagcgugugcaugaccaucgggcuggccaaccucauccugcagaucggcaacaucaucuccaucuggaucagccacuccauccagcuggggaaccagaaccagaucgagacgugcaaccagagcgucaucuccuacgagaacaacaccugggugaaccagaccuacgugaacaucagcaacaccaacuucgccgcgggccaguccgucgugagcgugaagcucgccgggaacuccagccugugcccggucuccggcugggccaucuacagcaaggacaacuccgugcgcaucggcagcaagggggacguguucgucauccgggagcccuucaucuccugcagcccccuggagugccgcacguucuuccucacccagggcgcccugcugaacgacaagcacuccaacgggaccaucaaggaccggagccccuaccgcacccucauguccugcccgaucggcgaggugcccagccccuacaacagccgguucgaguccguggccuggagcgcguccgccugccacgacgggaucaacuggcugacgaucggcaucagcggccccgacaacggggccgucgccgugcugaaguacaacggcaucaucaccgacaccaucaaguccuggcgcaacaacauccuccggacccaggagagcgagugcgcgugcgugaacggguccugcuucacggucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccggaucggguacaucugcagcggcaucuucggggacaacccgcgccccaacgacaagaccggcuccugcggccccgugagcuccaacggggccaacggcgucaagggguucagcuucaaguacggcaacgggguguggaucggccggaccaagagcaucuccagccgcaacggcuucgagaugaucugggaccccaacggguggaccggcaccgacaagaacuucuccaucaagcaggacaucguggggaucaacgaguggagcggcuacuccgggagcuucguccagcacccggagcugaccggccucgacugcauccggcccugcuucuggguggagcugauccgcggccggcccaaggagaacacgaucuggaccuccgggagcuccaucagcuucugcggcgucaacuccgacaccgugggguggagcuggcccgacggcgccgagcugccguucaccaucgacaaguga

SEQ ID NO: 79592 - RNA, 1410 nt, Artificial Sequence; identical to SEQ ID NO: 77746
  derived and/or modified sequence opt1 from neuraminidase__InfluenzaA__ADF27998

SEQ ID NO: 79593 - RNA, 1410 nt, Artificial Sequence; identical to SEQ ID NO: 77746
  derived and/or modified sequence opt1 from neuraminidase__InfluenzaA__ADF28008

SEQ ID NO: 79594 - RNA, 1410 nt, Artificial Sequence; identical to SEQ ID NO: 78633
  derived and/or modified sequence opt1 from neuraminidase__InfluenzaA__ADF28018

SEQ ID NO: 79595 - RNA, 1410 nt, Artificial Sequence; identical to SEQ ID NO: 77746
  derived and/or modified sequence opt1 from neuraminidase__InfluenzaA__ADF28028

SEQ ID NO: 79596 - RNA, 1410 nt, Artificial Sequence
  derived and/or modified sequence opt1 from neuraminidase__InfluenzaA__ADF28038
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccaccggccagcuggucgugagcgugaagcucgcggggaacuccagccugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgaccggcacuccaacgggacgaucaaggaccgcagccccuaccggacccucauguccugcccgaucggcgagguccccagccccuacaacucccgcuucgagagcguggccuggagcgccuccgcgugccacgacgggaucaacuggcugaccaucggcaucagcggccccgacaacggggccguggccguccugaaguacaacggcaucaucaccgacacgaucaaguccuggcggaacaacauccuccgcacccaggagagcgagugcgccugcgugaacggguccugcuucaccgugaugaccgacggcccgagcgacggccaggcguccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccuggaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaaguccaucagcagccgcaacggcuucgagaugaucugggaccccaacggguggaccggcacggacaacaacuucuccaucaagcaggacaucguggggaucaacgaguggagcggcuacuccgggagcuucgugcagcacccggagcugaccggccucgacugcauccggcccugcuucugggucgagcugauccgcggccggcccaaggagaacaccaucuggaccuccgggagcuccaucagcuucugcggcgugaacuccgacacggucggguggagcuggcccgacggcgccgagcugccguucaccaucgacaaguga

SEQ ID NO: 79597 - RNA, 1410 nt, Artificial Sequence; identical to SEQ ID NO: 77746
  derived and/or modified sequence opt1 from neuraminidase__InfluenzaA__ADF28048

SEQ ID NO: 79598 - RNA, 1410 nt, Artificial Sequence; identical to SEQ ID NO: 77746
  derived and/or modified sequence opt1 from neuraminidase__InfluenzaA__ADF28058

SEQ ID NO: 79599 - RNA, 1410 nt, Artificial Sequence
  derived and/or modified sequence opt1 from neuraminidase__InfluenzaA__ADF28068
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccagccucugcccggucuccggcugggccaucuacagcaaggacaacuccauccgcaucggcagcaagggggacguguucgugauccgggagcccuucaucuccugcagccaccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugaccggccuggacugcauccgcccgugcuucugggucgagcucauccggggccgccccaaggagaacacgaucuggaccuccgggagcuccaucagcuucugcggcgugaacuccgacaccgucggguggagcuggcccgacggcgccgagcugcccuucaccaucgacaaguga

SEQ ID NO: 79600 - RNA, 1410 nt, Artificial Sequence; identical to SEQ ID NO: 77746
  derived and/or modified sequence opt1 from neuraminidase__InfluenzaA__ADF28078

SEQ ID NO: 79601 - RNA, 1410 nt, Artificial Sequence; identical to SEQ ID NO: 77746
  derived and/or modified sequence opt1 from neuraminidase__InfluenzaA__ADF28088

SEQ ID NO: 79602 - RNA, 1410 nt, Artificial Sequence; identical to SEQ ID NO: 79208
  derived and/or modified sequence opt1 from neuraminidase__InfluenzaA__ADF28110

SEQ ID NO: 79603 - RNA, 1410 nt, Artificial Sequence; identical to SEQ ID NO: 77746
  derived and/or modified sequence opt1 from neuraminidase__InfluenzaA__ADF28120

SEQ ID NO: 79604 - RNA, 1410 nt, Artificial Sequence; identical to SEQ ID NO: 77746
  derived and/or modified sequence opt1 from neuraminidase__InfluenzaA__ADF29919

SEQ ID NO: 79605 - RNA, 1410 nt, Artificial Sequence; identical to SEQ ID NO: 78883
  derived and/or modified sequence opt1 from neuraminidase__InfluenzaA__ADF42692

SEQ ID NO: 79606 - RNA, 1410 nt, Artificial Sequence; identical to SEQ ID NO: 77746
  derived and/or modified sequence opt1 from neuraminidase__InfluenzaA__ADF42702

SEQ ID NO: 79607 - RNA, 1410 nt, Artificial Sequence; identical to SEQ ID NO: 79581
  derived and/or modified sequence opt1 from neuraminidase__InfluenzaA__ADF42712

SEQ ID NO: 79608 - RNA, 1410 nt, Artificial Sequence; identical to SEQ ID NO: 77746
  derived and/or modified sequence opt1 from neuraminidase__InfluenzaA__ADF42722

SEQ ID NO: 79609 - RNA, 1410 nt, Artificial Sequence; identical to SEQ ID NO: 79034
  derived and/or modified sequence opt1 from neuraminidase__InfluenzaA__ADF42732

SEQ ID NO: 79610 - RNA, 1410 nt, Artificial Sequence; identical to SEQ ID NO: 77746
  derived and/or modified sequence opt1 from neuraminidase__InfluenzaA__ADF42742

SEQ ID NO: 79611 - RNA, 1410 nt, Artificial Sequence; identical to SEQ ID NO: 77736
  derived and/or modified sequence opt1 from neuraminidase__InfluenzaA__ADF58339

SEQ ID NO: 79612 - RNA, 1410 nt, Artificial Sequence; identical to SEQ ID NO: 77746
  derived and/or modified sequence opt1 from neuraminidase__InfluenzaA__ADF58348

SEQ ID NO: 79613 - RNA, 1410 nt, Artificial Sequence; identical to SEQ ID NO: 77746
  derived and/or modified sequence opt1 from neuraminidase__InfluenzaA__ADF58350

SEQ ID NO: 79614 - RNA, 1410 nt, Artificial Sequence; identical to SEQ ID NO: 77746
  derived and/or modified sequence opt1 from neuraminidase__InfluenzaA__ADF58352

SEQ ID NO: 79615 - RNA, 1410 nt, Artificial Sequence
  derived and/or modified sequence opt1 from neuraminidase__InfluenzaA__ADF80459
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucaccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccguguggaccuccgggagcuccaucagcuucugcggcgucaacuccgacacggugggguggagcuggcccgacggcgccgagcugccguucaccaucgacaaguga

SEQ ID NO: 79616 - RNA, 1410 nt, Artificial Sequence
  derived and/or modified sequence opt1 from neuraminidase__InfluenzaA__ADF80503
augaaccccaaccagaagaucaucaccaucggcagcgugugcaugaccaucgggauggccaaccugauccuccagaucggcaacaucacguccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 79617 - RNA, 1410 nt, Artificial Sequence
  derived and/or modified sequence opt1 from neuraminidase__InfluenzaA__ADF83744
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 79618 - RNA, 1410 nt, Artificial Sequence; identical to SEQ ID NO: 78600
  derived and/or modified sequence opt1 from neuraminidase__InfluenzaA__ADF83755

SEQ ID NO: 79619 - RNA, 1410 nt, Artificial Sequence
  derived and/or modified sequence opt1 from neuraminidase__InfluenzaA__ADF83766
augaaccccaaccagaagaucaucaccaucggcagcgugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacgacaacggcgucuggaucgggcgcaccaagagcaucagcucccggaacggcuucgagaugaucugggaccccaacggcuggaccgggacggacaacaacuucagcaucaagcaggacaucgugggcaucaacgagugguccggguacagcggcuccuucgugcagcacccggagcugaccgggcuggacugcauccgccccugcuucugggucgagcucauccggggccgccccaaggagaacaccaucuggaccagcggcuccagcaucuccuucugcggggugaacagcgacacggucggcugguccuggcccgacggggccgagcugccguucaccaucgacaaguga

SEQ ID NO: 79620 - RNA, 1410 nt, Artificial Sequence; identical to SEQ ID NO: 77746
  derived and/or modified sequence opt1 from neuraminidase__InfluenzaA__ADF83776

SEQ ID NO: 79621 - RNA, 1410 nt, Artificial Sequence
  derived and/or modified sequence opt1 from neuraminidase__InfluenzaA__ADF83786
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacggggacaccgucggcuggagcuggcccgacggcgccgagcugccguucacgaucgacaaguga

SEQ ID NO: 79622 - RNA, 1410 nt, Artificial Sequence
  derived and/or modified sequence opt1 from neuraminidase__InfluenzaA__ADF83796
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucgugcgcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 79623 - RNA, 1410 nt, Artificial Sequence; identical to SEQ ID NO: 77746
  derived and/or modified sequence opt1 from neuraminidase__InfluenzaA__ADF83806

SEQ ID NO: 79624 - RNA, 1410 nt, Artificial Sequence; identical to SEQ ID NO: 79259
  derived and/or modified sequence opt1 from neuraminidase__InfluenzaA__ADF83816

SEQ ID NO: 79625 - RNA, 1410 nt, Artificial Sequence; identical to SEQ ID NO: 77746
  derived and/or modified sequence opt1 from neuraminidase__InfluenzaA__ADF83826

SEQ ID NO: 79626 - RNA, 1410 nt, Artificial Sequence; identical to SEQ ID NO: 77746
  derived and/or modified sequence opt1 from neuraminidase__InfluenzaA__ADF83836

SEQ ID NO: 79627 - RNA, 1410 nt, Artificial Sequence; identical to SEQ ID NO: 77746
  derived and/or modified sequence opt1 from neuraminidase__InfluenzaA__ADF83846

SEQ ID NO: 79628 - RNA, 1410 nt, Artificial Sequence; identical to SEQ ID NO: 77746
  derived and/or modified sequence opt1 from neuraminidase__InfluenzaA__ADF83856

SEQ ID NO: 79629 - RNA, 1410 nt, Artificial Sequence; identical to SEQ ID NO: 79097
  derived and/or modified sequence opt1 from neuraminidase__InfluenzaA__ADF83866

SEQ ID NO: 79630 - RNA, 1410 nt, Artificial Sequence; identical to SEQ ID NO: 79527
  derived and/or modified sequence opt1 from neuraminidase__InfluenzaA__ADF83876

SEQ ID NO: 79631 - RNA, 1410 nt, Artificial Sequence; identical to SEQ ID NO: 79177
  derived and/or modified sequence opt1 from neuraminidase__InfluenzaA__ADF83888

SEQ ID NO: 79632 - RNA, 1410 nt, Artificial Sequence
  derived and/or modified sequence opt1 from neuraminidase__InfluenzaA__ADF83898
augaaccccaaccagaagaucaucaccaucggcagcgugugcaugaccaucgggauggccaaccugauccuccagaucggcaacaucaucuccaucuggaucagccacccgauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 79633 - RNA, 1410 nt, Artificial Sequence; identical to SEQ ID NO: 77746
  derived and/or modified sequence opt1 from neuraminidase__InfluenzaA__ADF83908

SEQ ID NO: 79634 - RNA, 1410 nt, Artificial Sequence; identical to SEQ ID NO: 77746
  derived and/or modified sequence opt1 from neuraminidase__InfluenzaA__ADF83918

SEQ ID NO: 79635 - RNA, 1410 nt, Artificial Sequence; identical to SEQ ID NO: 77746
  derived and/or modified sequence opt1 from neuraminidase__InfluenzaA__ADF84444

SEQ ID NO: 79636 - RNA, 1410 nt, Artificial Sequence; identical to SEQ ID NO: 77746
  derived and/or modified sequence opt1 from neuraminidase__InfluenzaA__ADF84462

SEQ ID NO: 79637 - RNA, 1410 nt, Artificial Sequence
  derived and/or modified sequence opt1 from neuraminidase__InfluenzaA__ADF84472
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 79638 - RNA, 1410 nt, Artificial Sequence
  derived and/or modified sequence opt1 from neuraminidase__InfluenzaA__ADF84482
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucgccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucagcugguccuggcccgacggggcggagcugccguucaccaucgacaaguga

SEQ ID NO: 79639 - RNA, 1410 nt, Artificial Sequence
  derived and/or modified sequence opt1 from neuraminidase__InfluenzaA__ADF84492
augaaccccaaccagaagaucaucaccaucggcagcgugugcaugaccaucgggauggccaaccugauccuccagaucggcaacaucaucuccaucuggaucagccacuccauccagcuggggaaccaggaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79640 - RNA, 1410 nt, Artificial Sequence; identical to SEQ ID NO: 78853
  derived and/or modified sequence opt1 from neuraminidase__InfluenzaA__ADF85020

SEQ ID NO: 79641 - RNA, 1410 nt, Artificial Sequence; identical to SEQ ID NO: 77746
  derived and/or modified sequence opt1 from neuraminidase__InfluenzaA__ADF87155

SEQ ID NO: 79642 - RNA, 1410 nt, Artificial Sequence
  derived and/or modified sequence opt1 from neuraminidase__InfluenzaA__ADF87165
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgacaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucgccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgcggagcugccguucaccaucgacaaguga

SEQ ID NO: 79643 - RNA, 1410 nt, Artificial Sequence; identical to SEQ ID NO: 79637
  derived and/or modified sequence opt1 from neuraminidase__InfluenzaA__ADF87175

SEQ ID NO: 79644 - RNA, 1410 nt, Artificial Sequence; identical to SEQ ID NO: 77746
  derived and/or modified sequence opt1 from neuraminidase__InfluenzaA__ADF87185

SEQ ID NO: 79645 - RNA, 1410 nt, Artificial Sequence; identical to SEQ ID NO: 79637
  derived and/or modified sequence opt1 from neuraminidase__InfluenzaA__ADF87195

SEQ ID NO: 79646 - RNA, 1410 nt, Artificial Sequence; identical to SEQ ID NO: 77746
  derived and/or modified sequence opt1 from neuraminidase__InfluenzaA__ADF87205

SEQ ID NO: 79647 - RNA, 1410 nt, Artificial Sequence; identical to SEQ ID NO: 77746
  derived and/or modified sequence opt1 from neuraminidase__InfluenzaA__ADF87215

SEQ ID NO: 79648 - RNA, 1410 nt, Artificial Sequence
  derived and/or modified sequence opt1 from neuraminidase__InfluenzaA__ADF87235
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 79649 - RNA, 1410 nt, Artificial Sequence; identical to SEQ ID NO: 79637
  derived and/or modified sequence opt1 from neuraminidase__InfluenzaA__ADF87245

SEQ ID NO: 79650 - RNA, 1410 nt, Artificial Sequence; identical to SEQ ID NO: 79637
  derived and/or modified sequence opt1 from neuraminidase__InfluenzaA__ADF87265

SEQ ID NO: 79651 - RNA, 1410 nt, Artificial Sequence
  derived and/or modified sequence opt1 from neuraminidase__InfluenzaA__ADF87285
augaaccccaaccagaagaucaucaccaucggcagcgugugcauguccaucgggauggccaaccugauccuccagaucggcaacaucaucagcaucuggaucucccacagcauccagcuggggaacaagaaccagaucgagaccugcaaccaguccgucaucacguacgagaacaacaccugggugaaccagaccuacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaugaacgaguggagcggcuacuccgggagcuucgugcagcacccggagcugaccggccuggacugcauccgccccugcuucugggucgagcucauccggggccgccccaaggagaacaccaucuggacguccgggagcuccaucagcuucugcggcgugaacuccgacaccgucggguggagcuggcccgacggcgccgagcugccguucaccaucgacaaguga

SEQ ID NO: 79652 - RNA, 1410 nt, Artificial Sequence; identical to SEQ ID NO: 77746
  derived and/or modified sequence opt1 from neuraminidase__InfluenzaA__ADF87295

SEQ ID NO: 79653 - RNA, 1410 nt, Artificial Sequence; identical to SEQ ID NO: 77746
  derived and/or modified sequence opt1 from neuraminidase__InfluenzaA__ADF87305

SEQ ID NO: 79654 - RNA, 1410 nt, Artificial Sequence; identical to SEQ ID NO: 77746
  derived and/or modified sequence opt1 from neuraminidase__InfluenzaA__ADF87334

SEQ ID NO: 79655 - RNA, 1410 nt, Artificial Sequence; identical to SEQ ID NO: 77746
  derived and/or modified sequence opt1 from neuraminidase__InfluenzaA__ADF87344

SEQ ID NO: 79656 - RNA, 1410 nt, Artificial Sequence
  derived and/or modified sequence opt1 from neuraminidase__InfluenzaA__ADF87354
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacuacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79657 - RNA, 1410 nt, Artificial Sequence; identical to SEQ ID NO: 78329
  derived and/or modified sequence opt1 from neuraminidase__InfluenzaA__ADF87364

SEQ ID NO: 79658 - RNA, 1410 nt, Artificial Sequence; identical to SEQ ID NO: 77746
  derived and/or modified sequence opt1 from neuraminidase__InfluenzaA__ADF87374

SEQ ID NO: 79659 - RNA, 1410 nt, Artificial Sequence
  derived and/or modified sequence opt1 from neuraminidase__InfluenzaA__ADF87384
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79660 - RNA, 1410 nt, Artificial Sequence; identical to SEQ ID NO: 77746
  derived and/or modified sequence opt1 from neuraminidase__InfluenzaA__ADF97251

SEQ ID NO: 79661 - RNA, 1410 nt, Artificial Sequence; identical to SEQ ID NO: 78989
  derived and/or modified sequence opt1 from neuraminidase__InfluenzaA__ADF97252

SEQ ID NO: 79662 - RNA, 1410 nt, Artificial Sequence; identical to SEQ ID NO: 77746
  derived and/or modified sequence opt1 from neuraminidase__InfluenzaA__ADF97253

SEQ ID NO: 79663 - RNA, 1410 nt, Artificial Sequence; identical to SEQ ID NO: 77746
  derived and/or modified sequence opt1 from neuraminidase__InfluenzaA__ADF97254

SEQ ID NO: 79664 - RNA, 1410 nt, Artificial Sequence
  derived and/or modified sequence opt1 from neuraminidase__InfluenzaA__ADF97255
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaaccacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79665 - RNA, 1410 nt, Artificial Sequence; identical to SEQ ID NO: 77746
  derived and/or modified sequence opt1 from neuraminidase__InfluenzaA__ADF97256

SEQ ID NO: 79666 - RNA, 1410 nt, Artificial Sequence; identical to SEQ ID NO: 77746
  derived and/or modified sequence opt1 from neuraminidase__InfluenzaA__ADF97257

SEQ ID NO: 79667 - RNA, 1410 nt, Artificial Sequence; identical to SEQ ID NO: 78100
  derived and/or modified sequence opt1 from neuraminidase__InfluenzaA__ADF97837

SEQ ID NO: 79668 - RNA, 1410 nt, Artificial Sequence; identical to SEQ ID NO: 77746
  derived and/or modified sequence opt1 from neuraminidase__InfluenzaA__ADG08120

SEQ ID NO: 79669 - RNA, 1350 nt, Artificial Sequence
  derived and/or modified sequence opt1 from neuraminidase__InfluenzaA__ADG21408
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaaccucucccugugccccgugagcgggugggccguguacuccaaggacaacagcauccgcaucggcucccggggcgacgucuucgugauccgcgagcccuucaucagcugcucccaccuggagugccggaccuucuuccucacgcagggggcccugcugaacgacaagcacagcaacggcaccgugaaggaccgcagcccccaccggacccucauguccugcccggucggggaggcccccucccccuacaacagccgcuucgaguccguggccuggagcgcgagcgccugccacgacggcaccuccuggcugacgaucgggaucagcggccccgacaacggcgccguggccguccugaaguacaacgggaucaucaccgacaccaucaaguccuggcggaacaacaucaugcgcacccaggagagcgagugcgcgugcgugaacggcuccugcuucacggugaugaccgacgggccgagcuccggccaggccagcuacaagaucuucaagauggagaagggcaaggucgugaaguccguggagcucgacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccgucuuccccaacggcgccuacggggugaagggcuucuccuucaaguacgggaacggcguguggaucggccgcaccaagagcaccaacucccggagcggguucgagaugaucugggacccgaacggcuggaccgggaccgacuccagcuucagcgucaagcaggacaucguggcgaucacggacugguccggcuacagcggguccuucguccagcaccccgagcugaccggccucgacugcauccgccccugcuucuggguggagcugauccggggccgccccaaggagagcaccaucuggaccuccgggagcuccaucagcuucugcggcgugaacggggacacggucuccuggagcuggccggacggcgccgagcugcccuucaccaucgacaaguga

SEQ ID NO: 79670 - RNA, 1350 nt, Artificial Sequence; identical to SEQ ID NO: 78031
  derived and/or modified sequence opt1 from neuraminidase__InfluenzaA__ADG21409

SEQ ID NO: 79671 - RNA, 1350 nt, Artificial Sequence; identical to SEQ ID NO: 78031
  derived and/or modified sequence opt1 from neuraminidase__InfluenzaA__ADG21415

SEQ ID NO: 79672 - RNA, 1350 nt, Artificial Sequence; identical to SEQ ID NO: 78031
  derived and/or modified sequence opt1 from neuraminidase__InfluenzaA__ADG21417

SEQ ID NO: 79673 - RNA, 1350 nt, Artificial Sequence
  derived and/or modified sequence opt1 from neuraminidase__InfluenzaA__ADG21419
augaaccccaaccagaagaucaucaccaucggcagcaucugcauggugaucgggaucgucucccugaugcuccagaucggcaacaugaucagcaucugggugucccacagcauccagaccgggaaccagugccaggacgaguccaucagcaacacgaaguuccugaccgagaaggccguggccuccgucacccuggcgggcaacagcucccucugcccgaucagcgggugggccguguacuccaaggacaacagcauccgcaucggcucccggggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugccccgugggggaggccccgucccccuacaacagccgcuucgagagcgucgccugguccgcgagcgccugccacgacggcaccuccuggcucacgaucgggaucagcggccccgacaacggcgccguggccgugcugaaguacaacgggaucaucaccgacaccaucaaguccuggcggaacaacaucaugcgcacccaggagagcgagugcgcgugcgucaacggcuccugcuucacggugaugaccgacgggcccagcuccggccaggccagcuacaagaucuucaagauggagaagggcaagguggucaaguccguggagcuggacgccccgaacuaccacuacgaggagugcagcugcuaccccgacgccggggagaucacgugcgugugccgggacaacuggcacggcuccaaccgccccugggucagcuucaaccagaaccucgaguaccagaucggguacaucugcuccggcguguucggggacaacccccggccgaacgacggcaccggcagcugcgggcccguguuccccaacggcgccuacggggucaagggcuucuccuucaaguacgggaacggcguguggaucggccgcaccaagagcaccaacucccggagcggguucgagaugaucugggaccccaacggcuggaccgggaccgacagcuccuucagcgugaagcaggacaucgucgcgaucacggacugguccggcuacagcggguccuucgugcagcacccggagcugaccggccuggacugcauccgccccugcuucugggucgagcucauccggggccgccccaaggagagcaccaucuggaccuccgggagcuccaucagcuucugcggcgugaacggggacacgguguccuggagcuggcccgacggcgccgagcugccguucaccaucgacaaguga

SEQ ID NO: 79674 - RNA, 1350 nt, Artificial Sequence
  derived and/or modified sequence opt1 from neuraminidase__InfluenzaA__ADG21423
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacagcuggcacggcuccaaccgccccugggucagcuucaaccagaaccucgaguaccagaucggguacaucugcuccggcguguucggggacaacccgcggcccaacgacggcaccggcagcugcgggcccguguuccccaacggcgccuacggggucaagggcuucuccuucaaguacgggaacggcguguggaucggccgcaccaagagcaccaacucccggagcggguucgagaugaucugggacccgaacggcuggaccgggaccgacagcuccuucagcgugaagcaggacaucgucgcgaucacggacugguccggcuacagcggguccuucgugcagcaccccgagcugaccggccuggacugcauccgccccugcuucugggucgagcucauccggggccgccccaaggagagcaccaucuggaccuccgggagcuccaucagcuucugcggcgugaacggggacacgguguccuggagcuggccggacggcgccgagcugcccuucaccaucgacaaguga

SEQ ID NO: 79675 - RNA, 1350 nt, Artificial Sequence
  derived and/or modified sequence opt1 from neuraminidase__InfluenzaA__ADG21424
augaaccccaaccagaagaucaucaccaucggcagcaucugcauggugaucgggaucgccucccugaugcuccagaucggcaacaugaucagcaucugggucucccacagcauccagaccgggaaccagugccaggacgaguccaucagcaacacgaaguuccugaccgagaaggccguggcguccgugacccuggccggcaacagcucccucugcccgaucagcgggugggccgucuacuccaaggacaacagcauccgcaucggcuccaagggcgacguguucgugauccgggagcccuucaucagcugcucccaccuggagugccgcaccuucuuccugacgcagggggcccuccugaacgacaagcacagcaacggcaccgucaaggaccggagcccccaccgcacccugauguccugccccgugggggaggccccgucccccuacaacagccgguucgagagcguggcgugguccgccagcgccugccacgacggcaccuccuggcucacgaucgggaucagcggccccgacaacggcgccgucgcggugcugaaguacaacgggaucaucaccgacaccaucaaguccuggcgcaacaacaucaugcggacccaggagagcgagugcgccugcgugaacggcuccugcuucacggucaugaccgacgggcccagcuccggccaggccagcuacaagaucuucaagauggagaagggcaagguggugaaguccgucgagcuggacgccccgaacuaccacuacgaggagugcagcugcuaccccgacgccggggagaucacgugcgugugccgcgacaacuggcacggcuccaaccggcccugggugagcuucaaccagaaccucgaguaccagaucggguacaucugcuccggcgucuucggggacaacccccgcccgaacgacggcaccggcagcugcgggcccguguuccccaacggcgcguacggggugaagggcuucuccuucaaguacgggaacggcgucuggaucggccggaccaagagcaccaacucccgcagcggguucgagaugaucugggaccccaacggcuggaccgggaccgacagcuccuucagcgugaagcaggacaucguggccaucacggacugguccggcuacagcggguccuucguccagcacccggagcugaccggccuggacugcauccggcccugcuucuggguggagcucauccgcggccggcccaaggagagcaccaucuggaccuccgggagcuccaucagcuucugcggcgucaacggggacacgguguccuggagcuggcccgacggcgccgagcugccguucaccaucgacaaguga

SEQ ID NO: 79676 - RNA, 1350 nt, Artificial Sequence
  derived and/or modified sequence opt1 from neuraminidase__InfluenzaA__ADG21426
augaaccccaaccagaagaucaucaccaucggcagcaucugcauggugaucgggaucgucucccugaugcuccagaucggcaacaugaucagcaucugggugucccacagcauccagaccgagaaccagugccaggacgagccgaucuccaacacgaaguuccugaccgagaaggccguggccagcgucacccuggcggggaacuccagccucugccccaucuccggcugggccguguacagcaaggacaacuccauccgcaucgggagccggggcgacguguucgucauccgcgagcccuucaucuccugcagccaccuggagugccggaccuucuuccugacgcagggcgcccuccugaacgacaagcacuccaacgggaccgugaaggaccgcagcccccaccggacccugauguccugcccggugggcgaggcccccagccccuacaacucccgcuucgagagcgucgccuggagcgcguccgccugccacgacgggaccagcuggcucacgaucggcaucuccgggcccgacaacggcgccguggccgugcugaaguacaacggcaucaucaccgacaccaucaagagcuggcggaacaacaucaugcgcacccaggaguccgagugcgcgugcgucaacgggagcugcuucacggugaugaccgacggcccguccagcgggcaggccuccuacaagaucuucaagauggagaagggcaagguggucaagagcguggagcuggacgcccccaacuaccacuacgaggagugcuccugcuaccccgacgccggcgagaucacgugcgugugccgggacaacuggcacgggagcaaccgccccugggucuccuucaaccagaaccucgaguaccagaucggcuacaucugcagcgggguguucggcgacaacccgcggcccaacgacgggaccggcuccugcggccccguguuccccaacggggccuacggcgucaagggguucagcuucaaguacggcaacgggguguggaucggccgcaccaaguccaccaacagccgguccggcuucgagaugaucugggacccgaacggguggaccggcaccgacagcagcuucuccgugcgccaggacaucgucgcgaucacggacuggagcggguacuccggcagcuucgugcagcaccccgagcugaccgggcuggacugcauccggcccugcuucugggucgagcucauccgcggccggcccaaggaguccaccaucuggaccagcggcuccagcaucuccuucugcggggugaacggcgacacggugagcugguccuggccggacggggccgagcugcccuucaccaucgacaaguga

SEQ ID NO: 79677 - RNA, 1350 nt, Artificial Sequence
  derived and/or modified sequence opt1 from neuraminidase__InfluenzaA__ADG21428
augaaccccaaccagaagaucaucaccaucggcagcaucugcauggugaucgggaucgucucccugaugcuccagaucggcaacaugaucagcaucugggugucccacccgauccagaccgggaaccagugccaggacaagcccaucagcaacacgaaguuccugaccgagaaggccguggccuccgucacccuggcgggcaacagcucccucugccccaucagcgggugggccguguacuccaaggacaacagcauccgcaucggcucccggggcgacguguucgucauccgcgagcccuucaucagcugcucccaccuggagugccggaccuucuuccugacgcagggggcccuccugaacgacaagcacagcaacggcaccgugaaggaccgcuccccgcaccggacccugaugagcugccccgugggggaggcccccucccccuacaacagccgcuucgaguccgucgccuggagcgcgagcgccugccacgacggcaccuccuggcucacgaucgggaucagcggcccggacaacggcgccguggccgugcugaaguacaacgggaucaucaccgacaccaucaaguccuggcggaacagcaucaugcgcacccaggaguccgagugcgcgugcgucaacggcagcugcuucacggugaugaccgacgggcccuccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgcccgugggucuccuucaaccagaaccucgaguaccagaucggguacaucugcagcggcguguucggggacaacccccggcccaacgacggcaccggcuccugcgggcccguguucccgaacggcgccuacggggucaagggcuucagcuucaaguacgggaacggcguguggaucggccgcaccaaguccaccaacagccgguccggguucgagaugaucugggaccccaacggcuggaccgggaccgacagcagcuucuccgugaagcaggacaucgucgcgaucacggacuggagcggcuacuccgggagcuucgugcagcaccccgagcugaccggccuggacugcauccgccccugcuucugggucgagcucauccggggccgcccgaaggaguccaccaucuggaccagcggguccagcaucuccuucugcggcgugaacggggacacggugagcugguccuggcccgacggcgccgagcugcccuucaccaucgacaaguga

SEQ ID NO: 79678 - RNA, 1350 nt, Artificial Sequence; identical to SEQ ID NO: 78031
  derived and/or modified sequence opt1 from neuraminidase__InfluenzaA__ADG21430

SEQ ID NO: 79679 - RNA, 1350 nt, Artificial Sequence
  derived and/or modified sequence opt1 from neuraminidase__InfluenzaA__ADG21432
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccugggucuccuucaaccagaaccucgaguaccagaucggguacaucugcagcggcguguucggggacaacccgcggcccaacgacggcaccggcuccugcgggcccguguuccccaacggcgccuacggggucaagggcuucagcuuccgcuacgggaacggcguguggaucggccggaccaaguccaccaacagccgcuccggguucgagaugaucugggacccgaacggcuggaccgggaccgacagcagcuucuccgugaagcaggacaucgucgcgaucacggacuggagcggcuacuccgggagcuucgugcagcaccccgagcugaccggccuggacugcauccggcccugcuucugggucgagcucauccgcggccggcccaaggaguccaccaucuggaccagcggguccagcaucuccuucugcggcgugaacggggacacggugagcugguccuggccggacggcgccgagcugcccuucaccaucgacaaguga

SEQ ID NO: 79680 - RNA, 1350 nt, Artificial Sequence
  derived and/or modified sequence opt1 from neuraminidase__InfluenzaA__ADG21438
augaaccccaaccagaagaucaucaccaucggcagcaucugcauggugaucgggaucgucucccugaugcuccagaucggcaacaugaucagcaucuggaucucccacagcauccagaccgggaaccagugccaggacgagccgaucuccaacacgaaguuccugaccgagaaggccguggccagcgugacccuggcgggcaacuccagccucugccccaucuccgggugggccgucuacagcaaggacaacuccauccgcaucggcagccggggcgacguguucgugauccgcgagcccuucaucuccugcagccaccuggagugccggaccuucuuccugacgcagggggcccuccugaacgacaagcacuccaacggcaccgucaaggaccgcagcccccaccggacccugauguccugcccggugggggaggcccccagccccuacaacucccgcuucgagagcguggccuggagcgcguccgccugccacgacggcaccagcuggcucacgaucgggaucuccggccccgacaacggcgccgucgccgugcugaaguacaacgggaucaucaccgacaccaucaagagcuggcggaacaacaucaugcgcacccaggaguccgagugcgcgugcgugaacggcagcugcuucacggucaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccuggguguccuucaaccagaaccucgaguaccagaucggguacaucugcagcggcgucuucggggacaacccgcggcccaacgacggcaccggcuccugcgggcccguguuccccaacggcgccuacggggugaagggcuucagcuucaaguacggguccggcgucuggaucggccgcaccaagagcaccaacucccggagcggguucgagaugaucugggacccgaacggcuggaccgggaccgacagcuccuucagcgugaagcaggacaucguggcgaucacggacugguccggcuacagcggguccuucguccagcaccccgagcugaccggccuggacugcauccgccccugcuucuggguggagcucauccggggccgccccaaggagagcaccaucuggaccuccgggagcuccaucagcuucugcggcgucaacggggacacgguguccuggagcuggccggacggcgccgagcugcccuucaccaucgacaaguga

SEQ ID NO: 79681 - RNA, 1350 nt, Artificial Sequence
  derived and/or modified sequence opt1 from neuraminidase__InfluenzaA__ADG21440
augaaccccaaccagaagaucaucaccaucggcagcaucugcauggugaucgggaucgccucccugaugcuccagaucggcaacaugaucagcaucugggucucccacagcauccagaccgggaaccagugccaggacgaguccaucagcaacacgaaguuccugaccgagaaggccguggcguccgugacccuggccggcaacagcucccucugcccgaucagcgggugggccgucuacuccaaggacaacagcauccgcaucggcucccggggcgacguguucgugauccgcgagcccuucaucagcugcucccaccuggagugccggaccuucuuccugacgcagggggcccuccugaacgacaagcacagcaacggcaccgucaaggaccgcagcccccaccggacccugauguccugccccgugggggaggccccgucccccuacaacagccgcuucgagagcguggcgugguccgccagcgccugccacgacggcaccuccuggcucacgaucgggaucagcggccccgacaacggcgccgucgcggugcugaaguacaacgggaucaucaccgacaccaucaaguccuggcggaacaacaucaugcgcacccaggagagcgagugcgccugcgugaacggcuccugcuucacggucaugaccgacgggcccagcuccggccaggccagcuacaagaucuucaagauggagaagggcaagguggugaaguccgucgagcuggacgccccgaacuaccacuacgaggagugcagcugcuaccccgacgccggggagaucacgugcgugugccgggacaacuggcacggcuccaaccgccccugggugagcuucaaccagaaccucgaguaccagaucggguacaucugcuccggcgucuucggggacaacccccggccgaacgacggcaccggcagcugcgggcccguguuccccaacggcgcguacggggugaagggcuucuccuucaaguacgggaacggcgucuggaucggccgcaccaagagcaccaacucccggagcggguucgagaugaucugggaccccaacggcuggaccgggaccgacagcuccuucagcgugaagcaggacaucguggccaucacggacugguccggcuacagcggguccuucguccagcacccggagcugaccggccuggacugcauccgccccugcuucuggguggagcucauccggggccgccccaaggagagcaccaucuggaccuccgggagcuccaucagcuucugcggcgucaacggggacacgguguccuggagcuggcccgacggcgccgagcugccguucaccaucgacaaguga

SEQ ID NO: 79682 - RNA, 1350 nt, Artificial Sequence; identical to SEQ ID NO: 78031
  derived and/or modified sequence opt1 from neuraminidase__InfluenzaA__ADG21442

SEQ ID NO: 79683 - RNA, 1350 nt, Artificial Sequence
  derived and/or modified sequence opt1 from neuraminidase__InfluenzaA__ADG21444
augaaccccaaccagaagaucaucaccaucggcagcaucugcauggugaucgggaucgucucccugaugcuccagaucggcaacaugaucagcaucugggugucccacagcauccagaccgggaaccagugccaggacgaguccaucagcaacacgaaguuccugaccgagaaggccgugaccuccgucacccuggccggcaacagcucccucugcccgaucagcgggugggcgguguacuccaaggacaacagcauccgcaucggcucccggggcgacguguucgucauccgcgagcccuucaucagcugcucccaccuggagugccggacguucuuccugacccagggggcccuccugaacgacaagcacagcaacggcaccgugaaggaccgcagcccccaccggacccugauguccugccccgugggggaggccccgucccccuacaacagccgcuucgagagcgucgccugguccgccagcgcgugccacgacggcacguccuggcucaccaucgggaucagcggccccgacaacggcgccguggccgugcugaaguacaacgggaucaucaccgacaccaucaaguccuggcggaacaacaucaugcgcacgcaggagagcgagugcgccugcgucaacggcuccugcuucaccgugaugaccgacgggcccagcuccggccaggcgagcuacaagaucuucaagauggagaagggcaagguggucaaguccguggagcuggacgccccgaacuaccacuacgaggagugcagcugcuaccccgacgccggggagaucacgugcgugugccgggacaacuggcacggcuccaaccgccccuggaucagcuucaaccagaaccucgaguaccagaucggguacaucugcuccggcgucuucggggacaacccccggccgaacgacggcaccggcagcugcgggcccguguuccccaacggcgccuacggggugaagggcuucuccuucaaguacgggaacggcgucuggaucggccgcaccaagagcaccaacucccggagcggguucgagaugaucugggaccccaacggcuggaccgggacggacagcuccuucagcgugaagcaggacaucguggccaucaccgacugguccggcuacagcggguccuucguccagcacccggagcugaccggccuggacugcauccgccccugcuucuggguggagcucauccggggccgccccaaggagagcaccaucuggacguccgggagcuccaucagcuucugcggcgucaacggggacaccguguccuggagcuggcccgacggcgcggagcugccguucaccaucgacaaguga

SEQ ID NO: 79684 - RNA, 1350 nt, Artificial Sequence; identical to SEQ ID NO: 78031
  derived and/or modified sequence opt1 from neuraminidase__InfluenzaA__ADG21446

SEQ ID NO: 79685 - RNA, 1350 nt, Artificial Sequence
  derived and/or modified sequence opt1 from neuraminidase__InfluenzaA__ADG21448
augaaccccaaccagaagaucaucaccaucggcagcaucugcauggugaucgggaucgucucccugaugcuccagaucggcaacaugaucagcaucugggugucccacagcauccagaccgggaaccagugccaggacgagccgaucuccaacacgaaguuccugaccgagaaggccguggccagcgucacccuggcgggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccuggagcgcguccgccugccacgacggcaccagcuggcucacgaucgggaucuccggccccgacaacggcgccguggccgugcugaaguacaacgggaucaucaccgacaccaucaagagcuggcggaacaacaucaugcgcacccaggaguccgagugcgcgugcgucaacggcagcugcuucacggugaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccuggaucuccuucaaccagaaccucgaguaccagaucggguacaucugcagcggcgucuucggggacaacccgcggcccaacgacggcaccggcuccugcgggcccguguuccccaacggcgccuacggggugaagggcuucagcuucaaguacgggaacggcgucuggaucggccgcaccaaguccaccaacagccgguccggguucgagaugaucugggacccgaacggcuggaccgggaccgacagcagcuucuccgugaagcaggacaucguggcgaucacggacuggagcggcuacuccgggagcuucguccagcaccccgagcugaccggccuggacugcauccgccccugcuucuggguggagcucauccggggccgccccaaggaguccaccaucuggaccagcggguccagcaucuccuucugcggcgucaacggggacacggugagcugguccuggccggacggcgccgagcugcccuucaccaucgacaaguga

SEQ ID NO: 79686 - RNA, 1350 nt, Artificial Sequence; identical to SEQ ID NO: 79685
  derived and/or modified sequence opt1 from neuraminidase__InfluenzaA__ADG21450

SEQ ID NO: 79687 - RNA, 1410 nt, Artificial Sequence; identical to SEQ ID NO: 77746
  derived and/or modified sequence opt1 from neuraminidase__InfluenzaA__ADG27797

SEQ ID NO: 79688 - RNA, 1410 nt, Artificial Sequence
  derived and/or modified sequence opt1 from neuraminidase__InfluenzaA__ADG27983
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaaccaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccauggggugguccuggcccgacggcgccgagcugccguucacgaucgacaaguga

SEQ ID NO: 79689 - RNA, 1410 nt, Artificial Sequence; identical to SEQ ID NO: 77746
  derived and/or modified sequence opt1 from neuraminidase__InfluenzaA__ADG27989

SEQ ID NO: 79690 - RNA, 1410 nt, Artificial Sequence; identical to SEQ ID NO: 79688
  derived and/or modified sequence opt1 from neuraminidase__InfluenzaA__ADG27998

SEQ ID NO: 79691 - RNA, 1410 nt, Artificial Sequence; identical to SEQ ID NO: 78100
  derived and/or modified sequence opt1 from neuraminidase__InfluenzaA__ADG28013

SEQ ID NO: 79692 - RNA, 1410 nt, Artificial Sequence; identical to SEQ ID NO: 77746
  derived and/or modified sequence opt1 from neuraminidase__InfluenzaA__ADG42086

SEQ ID NO: 79693 - RNA, 1410 nt, Artificial Sequence; identical to SEQ ID NO: 77746
  derived and/or modified sequence opt1 from neuraminidase__InfluenzaA__ADG42096

SEQ ID NO: 79694 - RNA, 1410 nt, Artificial Sequence; identical to SEQ ID NO: 79323
  derived and/or modified sequence opt1 from neuraminidase__InfluenzaA__ADG42106

SEQ ID NO: 79695 - RNA, 1410 nt, Artificial Sequence; identical to SEQ ID NO: 77746
  derived and/or modified sequence opt1 from neuraminidase__InfluenzaA__ADG42116

SEQ ID NO: 79696 - RNA, 1410 nt, Artificial Sequence; identical to SEQ ID NO: 77746
  derived and/or modified sequence opt1 from neuraminidase__InfluenzaA__ADG42126

SEQ ID NO: 79697 - RNA, 1410 nt, Artificial Sequence; identical to SEQ ID NO: 77746
  derived and/or modified sequence opt1 from neuraminidase__InfluenzaA__ADG42136

SEQ ID NO: 79698 - RNA, 1410 nt, Artificial Sequence; identical to SEQ ID NO: 78329
  derived and/or modified sequence opt1 from neuraminidase__InfluenzaA__ADG42146

SEQ ID NO: 79699 - RNA, 1410 nt, Artificial Sequence; identical to SEQ ID NO: 77746
  derived and/or modified sequence opt1 from neuraminidase__InfluenzaA__ADG42156

SEQ ID NO: 79700 - RNA, 1410 nt, Artificial Sequence; identical to SEQ ID NO: 77746
  derived and/or modified sequence opt1 from neuraminidase__InfluenzaA__ADG42166

SEQ ID NO: 79701 - RNA, 1410 nt, Artificial Sequence; identical to SEQ ID NO: 77746
  derived and/or modified sequence opt1 from neuraminidase__InfluenzaA__ADG42186

SEQ ID NO: 79702 - RNA, 1410 nt, Artificial Sequence; identical to SEQ ID NO: 79637
  derived and/or modified sequence opt1 from neuraminidase__InfluenzaA__ADG42196

SEQ ID NO: 79703 - RNA, 1410 nt, Artificial Sequence
  derived and/or modified sequence opt1 from neuraminidase__InfluenzaA__ADG42206
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcaagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79704 - RNA, 1410 nt, Artificial Sequence; identical to SEQ ID NO: 77746
  derived and/or modified sequence opt1 from neuraminidase__InfluenzaA__ADG42216

SEQ ID NO: 79705 - RNA, 1410 nt, Artificial Sequence; identical to SEQ ID NO: 79097
  derived and/or modified sequence opt1 from neuraminidase__InfluenzaA__ADG42226

SEQ ID NO: 79706 - RNA, 1410 nt, Artificial Sequence; identical to SEQ ID NO: 77746
  derived and/or modified sequence opt1 from neuraminidase__InfluenzaA__ADG42236

SEQ ID NO: 79707 - RNA, 1410 nt, Artificial Sequence; identical to SEQ ID NO: 77746
  derived and/or modified sequence opt1 from neuraminidase__InfluenzaA__ADG42246

SEQ ID NO: 79708 - RNA, 1410 nt, Artificial Sequence; identical to SEQ ID NO: 77746
  derived and/or modified sequence opt1 from neuraminidase__InfluenzaA__ADG42256

SEQ ID NO: 79709 - RNA, 1410 nt, Artificial Sequence; identical to SEQ ID NO: 77746
  derived and/or modified sequence opt1 from neuraminidase__InfluenzaA__ADG42276

SEQ ID NO: 79710 - RNA, 1410 nt, Artificial Sequence
  derived and/or modified sequence opt1 from neuraminidase__InfluenzaA__ADG42296
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcgggcgcaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 79711 - RNA, 1410 nt, Artificial Sequence; identical to SEQ ID NO: 77746
  derived and/or modified sequence opt1 from neuraminidase__InfluenzaA__ADG42306

SEQ ID NO: 79712 - RNA, 1410 nt, Artificial Sequence; identical to SEQ ID NO: 77746
  derived and/or modified sequence opt1 from neuraminidase__InfluenzaA__ADG42316

SEQ ID NO: 79713 - RNA, 1410 nt, Artificial Sequence; identical to SEQ ID NO: 77746
  derived and/or modified sequence opt1 from neuraminidase__InfluenzaA__ADG42326

SEQ ID NO: 79714 - RNA, 1410 nt, Artificial Sequence
  derived and/or modified sequence opt1 from neuraminidase__InfluenzaA__ADG42336
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaaguucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79715 - RNA, 1410 nt, Artificial Sequence; identical to SEQ ID NO: 79208
  derived and/or modified sequence opt1 from neuraminidase__InfluenzaA__ADG42346

SEQ ID NO: 79716 - RNA, 1410 nt, Artificial Sequence; identical to SEQ ID NO: 78923
  derived and/or modified sequence opt1 from neuraminidase__InfluenzaA__ADG42356

SEQ ID NO: 79717 - RNA, 1410 nt, Artificial Sequence
  derived and/or modified sequence opt1 from neuraminidase__InfluenzaA__ADG42366
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccuggaucagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaaguucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79718 - RNA, 1410 nt, Artificial Sequence; identical to SEQ ID NO: 77746
  derived and/or modified sequence opt1 from neuraminidase__InfluenzaA__ADG42376

SEQ ID NO: 79719 - RNA, 1410 nt, Artificial Sequence
  derived and/or modified sequence opt1 from neuraminidase__InfluenzaA__ADG42386
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccgguccggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 79720 - RNA, 1410 nt, Artificial Sequence; identical to SEQ ID NO: 79703
  derived and/or modified sequence opt1 from neuraminidase__InfluenzaA__ADG42396

SEQ ID NO: 79721 - RNA, 1410 nt, Artificial Sequence
  derived and/or modified sequence opt1 from neuraminidase__InfluenzaA__ADG42406
augaaccccaaccagaagaucaucaccaucggcagcgugugcaugaccaucgggauggccaaccugauccuccagaucggcaacauccuguccacguggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79722 - RNA, 1410 nt, Artificial Sequence; identical to SEQ ID NO: 78923
  derived and/or modified sequence opt1 from neuraminidase__InfluenzaA__ADG42426

SEQ ID NO: 79723 - RNA, 1410 nt, Artificial Sequence; identical to SEQ ID NO: 77746
  derived and/or modified sequence opt1 from neuraminidase__InfluenzaA__ADG42436

SEQ ID NO: 79724 - RNA, 1410 nt, Artificial Sequence
  derived and/or modified sequence opt1 from neuraminidase__InfluenzaA__ADG42446
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 79725 - RNA, 1410 nt, Artificial Sequence
  derived and/or modified sequence opt1 from neuraminidase__InfluenzaA__ADG42456
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79726 - RNA, 1410 nt, Artificial Sequence; identical to SEQ ID NO: 77746
  derived and/or modified sequence opt1 from neuraminidase__InfluenzaA__ADG42466

SEQ ID NO: 79727 - RNA, 1410 nt, Artificial Sequence
  derived and/or modified sequence opt1 from neuraminidase__InfluenzaA__ADG42476
augaaccccaaccagaagaucaucaccaucggcagcgugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 79728 - RNA, 1410 nt, Artificial Sequence; identical to SEQ ID NO: 79648
  derived and/or modified sequence opt1 from neuraminidase__InfluenzaA__ADG42486

SEQ ID NO: 79729 - RNA, 1410 nt, Artificial Sequence; identical to SEQ ID NO: 77746
  derived and/or modified sequence opt1 from neuraminidase__InfluenzaA__ADG42496

SEQ ID NO: 79730 - RNA, 1410 nt, Artificial Sequence
  derived and/or modified sequence opt1 from neuraminidase__InfluenzaA__ADG42506
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcaucaucacguacgagaacaacaccugggucaaccagaccuacgugaacaucuccaacaccaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagagcgucgccugguccgcgagcgccugccacgacgggaucaacuggcucacgaucggcaucuccggccccgacaacggggccguggccgugcugaaguacaacggcaucaucaccgacaccaucaagagcuggcgcaacaacauccugcggacccaggaguccgagugcgcgugcgucaacgggagcugcuucacggugaugaccgacggcccguccgacggccaggccagcuacaagaucuuccgcaucgagaaggggaagguggucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79731 - RNA, 1410 nt, Artificial Sequence; identical to SEQ ID NO: 78921
  derived and/or modified sequence opt1 from neuraminidase__InfluenzaA__ADG42516

SEQ ID NO: 79732 - RNA, 1410 nt, Artificial Sequence
  derived and/or modified sequence opt1 from neuraminidase__InfluenzaA__ADG42526
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugccucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79733 - RNA, 1410 nt, Artificial Sequence
  derived and/or modified sequence opt1 from neuraminidase__InfluenzaA__ADG42536
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaccagcgacacggucgggugguccuggcccgacggcgccgagcugccguucaccaucgacaaguga

SEQ ID NO: 79734 - RNA, 1410 nt, Artificial Sequence; identical to SEQ ID NO: 77746
  derived and/or modified sequence opt1 from neuraminidase__InfluenzaA__ADG42546

SEQ ID NO: 79735 - RNA, 1410 nt, Artificial Sequence; identical to SEQ ID NO: 77746
  derived and/or modified sequence opt1 from neuraminidase__InfluenzaA__ADG42556

SEQ ID NO: 79736 - RNA, 1410 nt, Artificial Sequence
  derived and/or modified sequence opt1 from neuraminidase__InfluenzaA__ADG42566
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccacagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79737 - RNA, 1410 nt, Artificial Sequence
  derived and/or modified sequence opt1 from neuraminidase__InfluenzaA__ADG42576
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccuacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 79738 - RNA, 1410 nt, Artificial Sequence; identical to SEQ ID NO: 77746
  derived and/or modified sequence opt1 from neuraminidase__InfluenzaA__ADG42586

SEQ ID NO: 79739 - RNA, 1410 nt, Artificial Sequence
  derived and/or modified sequence opt1 from neuraminidase__InfluenzaA__ADG42606
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguuccccaucgacaaguga

SEQ ID NO: 79740 - RNA, 1410 nt, Artificial Sequence
  derived and/or modified sequence opt1 from neuraminidase__InfluenzaA__ADG42616
augaacagcaaccagaagaucaucaccaucggcuccgugugcaugaccaucgggauggccaaccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugccccgucuccggcugggccaucuacagcaaggacaacuccauccgcaucggcagcaagggggacguguucgugauccgggagccguucaucuccugcagcccccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 79741 - RNA, 1410 nt, Artificial Sequence; identical to SEQ ID NO: 78329
  derived and/or modified sequence opt1 from neuraminidase__InfluenzaA__ADG42626

SEQ ID NO: 79742 - RNA, 1410 nt, Artificial Sequence; identical to SEQ ID NO: 79727
  derived and/or modified sequence opt1 from neuraminidase__InfluenzaA__ADG42636

SEQ ID NO: 79743 - RNA, 1410 nt, Artificial Sequence
  derived and/or modified sequence opt1 from neuraminidase__InfluenzaA__ADG42646
augaaccccaaccagcgcaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 79744 - RNA, 1410 nt, Artificial Sequence; identical to SEQ ID NO: 77746
  derived and/or modified sequence opt1 from neuraminidase__InfluenzaA__ADG42656

SEQ ID NO: 79745 - RNA, 1410 nt, Artificial Sequence; identical to SEQ ID NO: 79659
  derived and/or modified sequence opt1 from neuraminidase__InfluenzaA__ADG42666

SEQ ID NO: 79746 - RNA, 1410 nt, Artificial Sequence
  derived and/or modified sequence opt1 from neuraminidase__InfluenzaA__ADG42676
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagaucugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 79747 - RNA, 1410 nt, Artificial Sequence; identical to SEQ ID NO: 77746
  derived and/or modified sequence opt1 from neuraminidase__InfluenzaA__ADG42686

SEQ ID NO: 79748 - RNA, 1410 nt, Artificial Sequence; identical to SEQ ID NO: 79323
  derived and/or modified sequence opt1 from neuraminidase__InfluenzaA__ADG42696

SEQ ID NO: 79749 - RNA, 1410 nt, Artificial Sequence; identical to SEQ ID NO: 79527
  derived and/or modified sequence opt1 from neuraminidase__InfluenzaA__ADG42706

SEQ ID NO: 79750 - RNA, 1410 nt, Artificial Sequence; identical to SEQ ID NO: 77746
  derived and/or modified sequence opt1 from neuraminidase__InfluenzaA__ADG42716

SEQ ID NO: 79751 - RNA, 1410 nt, Artificial Sequence; identical to SEQ ID NO: 79034
  derived and/or modified sequence opt1 from neuraminidase__InfluenzaA__ADG42726

SEQ ID NO: 79752 - RNA, 1410 nt, Artificial Sequence; identical to SEQ ID NO: 78329
  derived and/or modified sequence opt1 from neuraminidase__InfluenzaA__ADG42746

SEQ ID NO: 79753 - RNA, 1410 nt, Artificial Sequence; identical to SEQ ID NO: 79259
  derived and/or modified sequence opt1 from neuraminidase__InfluenzaA__ADG42756

SEQ ID NO: 79754 - RNA, 1410 nt, Artificial Sequence; identical to SEQ ID NO: 79034
  derived and/or modified sequence opt1 from neuraminidase__InfluenzaA__ADG42766

SEQ ID NO: 79755 - RNA, 1410 nt, Artificial Sequence; identical to SEQ ID NO: 79034
  derived and/or modified sequence opt1 from neuraminidase__InfluenzaA__ADG42776

SEQ ID NO: 79756 - RNA, 1410 nt, Artificial Sequence; identical to SEQ ID NO: 79034
  derived and/or modified sequence opt1 from neuraminidase__InfluenzaA__ADG42796

SEQ ID NO: 79757 - RNA, 1410 nt, Artificial Sequence
  derived and/or modified sequence opt1 from neuraminidase__InfluenzaA__ADG42806
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucuccuggagcuggcccgacggggccgagcugccguucacgaucgacaaguga

SEQ ID NO: 79758 - RNA, 1410 nt, Artificial Sequence; identical to SEQ ID NO: 77746
  derived and/or modified sequence opt1 from neuraminidase__InfluenzaA__ADG42816

SEQ ID NO: 79759 - RNA, 1410 nt, Artificial Sequence; identical to SEQ ID NO: 77746
  derived and/or modified sequence opt1 from neuraminidase__InfluenzaA__ADG42826

SEQ ID NO: 79760 - RNA, 1410 nt, Artificial Sequence; identical to SEQ ID NO: 77746
  derived and/or modified sequence opt1 from neuraminidase__InfluenzaA__ADG42836

SEQ ID NO: 79761 - RNA, 1410 nt, Artificial Sequence; identical to SEQ ID NO: 79362
  derived and/or modified sequence opt1 from neuraminidase__InfluenzaA__ADG42846

SEQ ID NO: 79762 - RNA, 1410 nt, Artificial Sequence; identical to SEQ ID NO: 77746
  derived and/or modified sequence opt1 from neuraminidase__InfluenzaA__ADG42856

SEQ ID NO: 79763 - RNA, 1410 nt, Artificial Sequence; identical to SEQ ID NO: 79358
  derived and/or modified sequence opt1 from neuraminidase__InfluenzaA__ADG42866

SEQ ID NO: 79764 - RNA, 1410 nt, Artificial Sequence; identical to SEQ ID NO: 77746
  derived and/or modified sequence opt1 from neuraminidase__InfluenzaA__ADG42876

SEQ ID NO: 79765 - RNA, 1410 nt, Artificial Sequence; identical to SEQ ID NO: 79395
  derived and/or modified sequence opt1 from neuraminidase__InfluenzaA__ADG42886

SEQ ID NO: 79766 - RNA, 1410 nt, Artificial Sequence; identical to SEQ ID NO: 79338
  derived and/or modified sequence opt1 from neuraminidase__InfluenzaA__ADG42896

SEQ ID NO: 79767 - RNA, 1410 nt, Artificial Sequence; identical to SEQ ID NO: 79338
  derived and/or modified sequence opt1 from neuraminidase__InfluenzaA__ADG42906

SEQ ID NO: 79768 - RNA, 1410 nt, Artificial Sequence; identical to SEQ ID NO: 77746
  derived and/or modified sequence opt1 from neuraminidase__InfluenzaA__ADG42916

SEQ ID NO: 79769 - RNA, 1410 nt, Artificial Sequence; identical to SEQ ID NO: 77746
  derived and/or modified sequence opt1 from neuraminidase__InfluenzaA__ADG42926

SEQ ID NO: 79770 - RNA, 1410 nt, Artificial Sequence; identical to SEQ ID NO: 77746
  derived and/or modified sequence opt1 from neuraminidase__InfluenzaA__ADG58909

SEQ ID NO: 79771 - RNA, 1410 nt, Artificial Sequence; identical to SEQ ID NO: 77746
  derived and/or modified sequence opt1 from neuraminidase__InfluenzaA__ADG58910

SEQ ID NO: 79772 - RNA, 1410 nt, Artificial Sequence
  derived and/or modified sequence opt1 from neuraminidase__InfluenzaA__ADG58913
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucaccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccuggacugcauccgccccugcuucuggaucgagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 79773 - RNA, 1410 nt, Artificial Sequence; identical to SEQ ID NO: 77746
  derived and/or modified sequence opt1 from neuraminidase__InfluenzaA__ADG58914

SEQ ID NO: 79774 - RNA, 1410 nt, Artificial Sequence; identical to SEQ ID NO: 77746
  derived and/or modified sequence opt1 from neuraminidase__InfluenzaA__ADG58916

SEQ ID NO: 79775 - RNA, 1410 nt, Artificial Sequence; identical to SEQ ID NO: 77746
  derived and/or modified sequence opt1 from neuraminidase__InfluenzaA__ADG58917

SEQ ID NO: 79776 - RNA, 1410 nt, Artificial Sequence
  derived and/or modified sequence opt1 from neuraminidase__InfluenzaA__ADG58918
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucaccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 79777 - RNA, 1410 nt, Artificial Sequence; identical to SEQ ID NO: 79772
  derived and/or modified sequence opt1 from neuraminidase__InfluenzaA__ADG58919

SEQ ID NO: 79778 - RNA, 1410 nt, Artificial Sequence; identical to SEQ ID NO: 77901
  derived and/or modified sequence opt1 from neuraminidase__InfluenzaA__ADG58920

SEQ ID NO: 79779 - RNA, 1410 nt, Artificial Sequence; identical to SEQ ID NO: 77901
  derived and/or modified sequence opt1 from neuraminidase__InfluenzaA__ADG58921

SEQ ID NO: 79780 - RNA, 1410 nt, Artificial Sequence; identical to SEQ ID NO: 77901
  derived and/or modified sequence opt1 from neuraminidase__InfluenzaA__ADG58922

SEQ ID NO: 79781 - RNA, 1410 nt, Artificial Sequence; identical to SEQ ID NO: 77901
  derived and/or modified sequence opt1 from neuraminidase__InfluenzaA__ADG58923

SEQ ID NO: 79782 - RNA, 1410 nt, Artificial Sequence; identical to SEQ ID NO: 77901
  derived and/or modified sequence opt1 from neuraminidase__InfluenzaA__ADG58924

SEQ ID NO: 79783 - RNA, 1410 nt, Artificial Sequence; identical to SEQ ID NO: 77901
  derived and/or modified sequence opt1 from neuraminidase__InfluenzaA__ADG58925

SEQ ID NO: 79784 - RNA, 1410 nt, Artificial Sequence; identical to SEQ ID NO: 77901
  derived and/or modified sequence opt1 from neuraminidase__InfluenzaA__ADG58926

SEQ ID NO: 79785 - RNA, 1410 nt, Artificial Sequence; identical to SEQ ID NO: 77901
  derived and/or modified sequence opt1 from neuraminidase__InfluenzaA__ADG58927

SEQ ID NO: 79786 - RNA, 1410 nt, Artificial Sequence; identical to SEQ ID NO: 78764
  derived and/or modified sequence opt1 from neuraminidase__InfluenzaA__ADG58928

SEQ ID NO: 79787 - RNA, 1410 nt, Artificial Sequence; identical to SEQ ID NO: 78764
  derived and/or modified sequence opt1 from neuraminidase__InfluenzaA__ADG58929

SEQ ID NO: 79788 - RNA, 1410 nt, Artificial Sequence
  derived and/or modified sequence opt1 from neuraminidase__InfluenzaA__ADG58931
augaaccccaaccagaagaucaucaccaucggcagcgugugcaugaccaucgggauggccaaccugauccuccagaucggcaacacgaucuccaucuggaucaaccacagcauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 79789 - RNA, 1410 nt, Artificial Sequence; identical to SEQ ID NO: 79788
  derived and/or modified sequence opt1 from neuraminidase__InfluenzaA__ADG58932

SEQ ID NO: 79790 - RNA, 1410 nt, Artificial Sequence; identical to SEQ ID NO: 79788
  derived and/or modified sequence opt1 from neuraminidase__InfluenzaA__ADG58933

SEQ ID NO: 79791 - RNA, 1410 nt, Artificial Sequence; identical to SEQ ID NO: 79788
  derived and/or modified sequence opt1 from neuraminidase__InfluenzaA__ADG58934

SEQ ID NO: 79792 - RNA, 1410 nt, Artificial Sequence; identical to SEQ ID NO: 79788
  derived and/or modified sequence opt1 from neuraminidase__InfluenzaA__ADG58935

SEQ ID NO: 79793 - RNA, 1410 nt, Artificial Sequence; identical to SEQ ID NO: 79788
  derived and/or modified sequence opt1 from neuraminidase__InfluenzaA__ADG58936

SEQ ID NO: 79794 - RNA, 1410 nt, Artificial Sequence; identical to SEQ ID NO: 79788
  derived and/or modified sequence opt1 from neuraminidase__InfluenzaA__ADG58937

SEQ ID NO: 79795 - RNA, 1410 nt, Artificial Sequence; identical to SEQ ID NO: 79788
  derived and/or modified sequence opt1 from neuraminidase__InfluenzaA__ADG58938

SEQ ID NO: 79796 - RNA, 1410 nt, Artificial Sequence
  derived and/or modified sequence opt1 from neuraminidase__InfluenzaA__ADG59589
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccauggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagguggucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79797 - RNA, 1410 nt, Artificial Sequence; identical to SEQ ID NO: 77746
  derived and/or modified sequence opt1 from neuraminidase__InfluenzaA__ADG59590

SEQ ID NO: 79798 - RNA, 1410 nt, Artificial Sequence; identical to SEQ ID NO: 77746
  derived and/or modified sequence opt1 from neuraminidase__InfluenzaA__ADG59591

SEQ ID NO: 79799 - RNA, 1410 nt, Artificial Sequence; identical to SEQ ID NO: 77746
  derived and/or modified sequence opt1 from neuraminidase__InfluenzaA__ADG59592

SEQ ID NO: 79800 - RNA, 1410 nt, Artificial Sequence; identical to SEQ ID NO: 79648
  derived and/or modified sequence opt1 from neuraminidase__InfluenzaA__ADG59593

SEQ ID NO: 79801 - RNA, 1410 nt, Artificial Sequence; identical to SEQ ID NO: 78923
  derived and/or modified sequence opt1 from neuraminidase__InfluenzaA__ADG59594

SEQ ID NO: 79802 - RNA, 1410 nt, Artificial Sequence; identical to SEQ ID NO: 78923
  derived and/or modified sequence opt1 from neuraminidase__InfluenzaA__ADG59595

SEQ ID NO: 79803 - RNA, 1410 nt, Artificial Sequence
  derived and/or modified sequence opt1 from neuraminidase__InfluenzaA__ADG59596
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgaccgcaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 79804 - RNA, 1410 nt, Artificial Sequence; identical to SEQ ID NO: 77746
  derived and/or modified sequence opt1 from neuraminidase__InfluenzaA__ADG59597

SEQ ID NO: 79805 - RNA, 1410 nt, Artificial Sequence; identical to SEQ ID NO: 77746
  derived and/or modified sequence opt1 from neuraminidase__InfluenzaA__ADG59598

SEQ ID NO: 79806 - RNA, 1410 nt, Artificial Sequence; identical to SEQ ID NO: 78921
  derived and/or modified sequence opt1 from neuraminidase__InfluenzaA__ADG59599

SEQ ID NO: 79807 - RNA, 1410 nt, Artificial Sequence; identical to SEQ ID NO: 77746
  derived and/or modified sequence opt1 from neuraminidase__InfluenzaA__ADG59601

SEQ ID NO: 79808 - RNA, 1410 nt, Artificial Sequence; identical to SEQ ID NO: 79648
  derived and/or modified sequence opt1 from neuraminidase__InfluenzaA__ADG59602

SEQ ID NO: 79809 - RNA, 1410 nt, Artificial Sequence; identical to SEQ ID NO: 79648
  derived and/or modified sequence opt1 from neuraminidase__InfluenzaA__ADG59603

SEQ ID NO: 79810 - RNA, 1410 nt, Artificial Sequence; identical to SEQ ID NO: 77746
  derived and/or modified sequence opt1 from neuraminidase__InfluenzaA__ADG59604

SEQ ID NO: 79811 - RNA, 1410 nt, Artificial Sequence; identical to SEQ ID NO: 77746
  derived and/or modified sequence opt1 from neuraminidase__InfluenzaA__ADG59605

SEQ ID NO: 79812 - RNA, 1410 nt, Artificial Sequence; identical to SEQ ID NO: 78764
  derived and/or modified sequence opt1 from neuraminidase__InfluenzaA__ADG59606

SEQ ID NO: 79813 - RNA, 1410 nt, Artificial Sequence; identical to SEQ ID NO: 77746
  derived and/or modified sequence opt1 from neuraminidase__InfluenzaA__ADG59607

SEQ ID NO: 79814 - RNA, 1410 nt, Artificial Sequence; identical to SEQ ID NO: 77746
  derived and/or modified sequence opt1 from neuraminidase__InfluenzaA__ADG59608

SEQ ID NO: 79815 - RNA, 1410 nt, Artificial Sequence; identical to SEQ ID NO: 78567
  derived and/or modified sequence opt1 from neuraminidase__InfluenzaA__ADG59609

SEQ ID NO: 79816 - RNA, 1410 nt, Artificial Sequence; identical to SEQ ID NO: 79648
  derived and/or modified sequence opt1 from neuraminidase__InfluenzaA__ADG59610

SEQ ID NO: 79817 - RNA, 1410 nt, Artificial Sequence; identical to SEQ ID NO: 78764
  derived and/or modified sequence opt1 from neuraminidase__InfluenzaA__ADG59611

SEQ ID NO: 79818 - RNA, 1410 nt, Artificial Sequence; identical to SEQ ID NO: 79648
  derived and/or modified sequence opt1 from neuraminidase__InfluenzaA__ADG59612

SEQ ID NO: 79819 - RNA, 1410 nt, Artificial Sequence
  derived and/or modified sequence opt1 from neuraminidase__InfluenzaA__ADG59613
augaaccccaaccagaagaucaucaccaucggcagcgugugcaugaccaucgggaugacgaaccugauccuccagcugggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgccggccagagcgucguguccgugaagcucgcggggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgccagcgcgugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacagcuucuccaucaagcaggacaucguggggaucaacgaguggagcggcuacuccgggagcuucgugcagcacccggagcugaccggccucgacugcauccgccccugcuucugggucgagcugauccggggccgccccaaggagaacaccguguggaccuccgggagcuccaucagcuucugcggcgucaacuccgacacggugggguggagcuggcccgacggcgccgagcugccguucaccaucgacaaguga

SEQ ID NO: 79820 - RNA, 1410 nt, Artificial Sequence; identical to SEQ ID NO: 78921
  derived and/or modified sequence opt1 from neuraminidase__InfluenzaA__ADG59614

SEQ ID NO: 79821 - RNA, 1410 nt, Artificial Sequence; identical to SEQ ID NO: 77746
  derived and/or modified sequence opt1 from neuraminidase__InfluenzaA__ADH01811

SEQ ID NO: 79822 - RNA, 1410 nt, Artificial Sequence; identical to SEQ ID NO: 77746
  derived and/or modified sequence opt1 from neuraminidase__InfluenzaA__ADH01821

SEQ ID NO: 79823 - RNA, 1410 nt, Artificial Sequence; identical to SEQ ID NO: 77746
  derived and/or modified sequence opt1 from neuraminidase__InfluenzaA__ADH01831

SEQ ID NO: 79824 - RNA, 1410 nt, Artificial Sequence; identical to SEQ ID NO: 77746
  derived and/or modified sequence opt1 from neuraminidase__InfluenzaA__ADH01841

SEQ ID NO: 79825 - RNA, 1410 nt, Artificial Sequence; identical to SEQ ID NO: 77746
  derived and/or modified sequence opt1 from neuraminidase__InfluenzaA__ADH01851

SEQ ID NO: 79826 - RNA, 1410 nt, Artificial Sequence; identical to SEQ ID NO: 77746
  derived and/or modified sequence opt1 from neuraminidase__InfluenzaA__ADH01861

SEQ ID NO: 79827 - RNA, 1410 nt, Artificial Sequence; identical to SEQ ID NO: 77746
  derived and/or modified sequence opt1 from neuraminidase__InfluenzaA__ADH01871

SEQ ID NO: 79828 - RNA, 1410 nt, Artificial Sequence; identical to SEQ ID NO: 77746
  derived and/or modified sequence opt1 from neuraminidase__InfluenzaA__ADH01881

SEQ ID NO: 79829 - RNA, 1410 nt, Artificial Sequence; identical to SEQ ID NO: 77746
  derived and/or modified sequence opt1 from neuraminidase__InfluenzaA__ADH01891

SEQ ID NO: 79830 - RNA, 1410 nt, Artificial Sequence; identical to SEQ ID NO: 77746
  derived and/or modified sequence opt1 from neuraminidase__InfluenzaA__ADH01901

SEQ ID NO: 79831 - RNA, 1410 nt, Artificial Sequence; identical to SEQ ID NO: 77746
  derived and/or modified sequence opt1 from neuraminidase__InfluenzaA__ADH01911

SEQ ID NO: 79832 - RNA, 1410 nt, Artificial Sequence; identical to SEQ ID NO: 77746
  derived and/or modified sequence opt1 from neuraminidase__InfluenzaA__ADH01921

SEQ ID NO: 79833 - RNA, 1410 nt, Artificial Sequence; identical to SEQ ID NO: 77746
  derived and/or modified sequence opt1 from neuraminidase__InfluenzaA__ADH01931

SEQ ID NO: 79834 - RNA, 1410 nt, Artificial Sequence; identical to SEQ ID NO: 79637
  derived and/or modified sequence opt1 from neuraminidase__InfluenzaA__ADH01941

SEQ ID NO: 79835 - RNA, 1410 nt, Artificial Sequence; identical to SEQ ID NO: 77746
  derived and/or modified sequence opt1 from neuraminidase__InfluenzaA__ADH01951

SEQ ID NO: 79836 - RNA, 1410 nt, Artificial Sequence; identical to SEQ ID NO: 77746
  derived and/or modified sequence opt1 from neuraminidase__InfluenzaA__ADH01961

SEQ ID NO: 79837 - RNA, 1410 nt, Artificial Sequence
  derived and/or modified sequence opt1 from neuraminidase__InfluenzaA__ADH01981
augaaccccaaccagaagaucaucaccaucggcagcgccugcaugaccaucgggauggccaaccugauccuccagaucggcaacaucaucuccaucuggaucagccacuccauccagcuggggaaccagaaccagacggagaccugcaaccagagcgugaucaccuacgagaacaacaccugggucaaccagacguacgugaacaucuccaacaccaacuucgcggccggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgcggagcugccguucaccaucgacaaguga

SEQ ID NO: 79838 - RNA, 1410 nt, Artificial Sequence; identical to SEQ ID NO: 79034
  derived and/or modified sequence opt1 from neuraminidase__InfluenzaA__ADH01991

SEQ ID NO: 79839 - RNA, 1410 nt, Artificial Sequence; identical to SEQ ID NO: 79703
  derived and/or modified sequence opt1 from neuraminidase__InfluenzaA__ADH02011

SEQ ID NO: 79840 - RNA, 1410 nt, Artificial Sequence; identical to SEQ ID NO: 78923
  derived and/or modified sequence opt1 from neuraminidase__InfluenzaA__ADH02021

SEQ ID NO: 79841 - RNA, 1410 nt, Artificial Sequence; identical to SEQ ID NO: 77746
  derived and/or modified sequence opt1 from neuraminidase__InfluenzaA__ADI24510

SEQ ID NO: 79842 - RNA, 1410 nt, Artificial Sequence; identical to SEQ ID NO: 77746
  derived and/or modified sequence opt1 from neuraminidase__InfluenzaA__ADI24516

SEQ ID NO: 79843 - RNA, 1410 nt, Artificial Sequence; identical to SEQ ID NO: 77746
  derived and/or modified sequence opt1 from neuraminidase__InfluenzaA__ADI24518

SEQ ID NO: 79844 - RNA, 1410 nt, Artificial Sequence; identical to SEQ ID NO: 77746
  derived and/or modified sequence opt1 from neuraminidase__InfluenzaA__ADI24522

SEQ ID NO: 79845 - RNA, 1410 nt, Artificial Sequence; identical to SEQ ID NO: 77746
  derived and/or modified sequence opt1 from neuraminidase__InfluenzaA__ADI24524

SEQ ID NO: 79846 - RNA, 1410 nt, Artificial Sequence; identical to SEQ ID NO: 77746
  derived and/or modified sequence opt1 from neuraminidase__InfluenzaA__ADI24526

SEQ ID NO: 79847 - RNA, 1410 nt, Artificial Sequence; identical to SEQ ID NO: 77746
  derived and/or modified sequence opt1 from neuraminidase__InfluenzaA__ADI24528

SEQ ID NO: 79848 - RNA, 1410 nt, Artificial Sequence; identical to SEQ ID NO: 77746
  derived and/or modified sequence opt1 from neuraminidase__InfluenzaA__ADI24530

SEQ ID NO: 79849 - RNA, 1410 nt, Artificial Sequence
  derived and/or modified sequence opt1 from neuraminidase__InfluenzaA__ADI24532
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcuccggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79850 - RNA, 1410 nt, Artificial Sequence; identical to SEQ ID NO: 77746
  derived and/or modified sequence opt1 from neuraminidase__InfluenzaA__ADI24538

SEQ ID NO: 79851 - RNA, 1410 nt, Artificial Sequence; identical to SEQ ID NO: 77746
  derived and/or modified sequence opt1 from neuraminidase__InfluenzaA__ADI24548

SEQ ID NO: 79852 - RNA, 1410 nt, Artificial Sequence; identical to SEQ ID NO: 77746
  derived and/or modified sequence opt1 from neuraminidase__InfluenzaA__ADI24556

SEQ ID NO: 79853 - RNA, 1410 nt, Artificial Sequence; identical to SEQ ID NO: 77746
  derived and/or modified sequence opt1 from neuraminidase__InfluenzaA__ADI24558

SEQ ID NO: 79854 - RNA, 1410 nt, Artificial Sequence; identical to SEQ ID NO: 77746
  derived and/or modified sequence opt1 from neuraminidase__InfluenzaA__ADI24560

SEQ ID NO: 79855 - RNA, 1410 nt, Artificial Sequence; identical to SEQ ID NO: 77746
  derived and/or modified sequence opt1 from neuraminidase__InfluenzaA__ADI24562

SEQ ID NO: 79856 - RNA, 1410 nt, Artificial Sequence; identical to SEQ ID NO: 77746
  derived and/or modified sequence opt1 from neuraminidase__InfluenzaA__ADI24564

SEQ ID NO: 79857 - RNA, 1410 nt, Artificial Sequence; identical to SEQ ID NO: 77746
  derived and/or modified sequence opt1 from neuraminidase__InfluenzaA__ADI24566

SEQ ID NO: 79858 - RNA, 1410 nt, Artificial Sequence; identical to SEQ ID NO: 77746
  derived and/or modified sequence opt1 from neuraminidase__InfluenzaA__ADI24568

SEQ ID NO: 79859 - RNA, 1410 nt, Artificial Sequence; identical to SEQ ID NO: 77746
  derived and/or modified sequence opt1 from neuraminidase__InfluenzaA__ADI24570

SEQ ID NO: 79860 - RNA, 1410 nt, Artificial Sequence; identical to SEQ ID NO: 77746
  derived and/or modified sequence opt1 from neuraminidase__InfluenzaA__ADI24572

SEQ ID NO: 79861 - RNA, 1410 nt, Artificial Sequence; identical to SEQ ID NO: 77746
  derived and/or modified sequence opt1 from neuraminidase__InfluenzaA__ADI24574

SEQ ID NO: 79862 - RNA, 1410 nt, Artificial Sequence; identical to SEQ ID NO: 77746
  derived and/or modified sequence opt1 from neuraminidase__InfluenzaA__ADI24576

SEQ ID NO: 79863 - RNA, 1410 nt, Artificial Sequence; identical to SEQ ID NO: 77746
  derived and/or modified sequence opt1 from neuraminidase__InfluenzaA__ADI24580

SEQ ID NO: 79864 - RNA, 1410 nt, Artificial Sequence; identical to SEQ ID NO: 78921
  derived and/or modified sequence opt1 from neuraminidase__InfluenzaA__ADI24582

SEQ ID NO: 79865 - RNA, 1410 nt, Artificial Sequence
  derived and/or modified sequence opt1 from neuraminidase__InfluenzaA__ADI24584
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccagccucugccccgucaacggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgagguccccucccccuacaacagccgguucgaguccguggccuggagcgcgagcgccugccacgacgggaucaacuggcucaccaucggcaucuccggcccggacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaccggcagcugcggccccguguccagcaacggggccaacggcgugaagggguucuccuucaaguacggcaacggggucuggaucggccgcaccaagagcaucuccagccggaacggcuucgagaugaucugggacccgaacggguggaccggcaccgacaacaacuucagcaucaagcaggacaucguggggaucaacgagugguccggcuacagcggguccuucgugcagcaccccgagcugacgggccuggacugcauccgccccugcuucugggucgagcucauccggggccgccccaaggagaacaccaucuggaccagcggguccagcaucuccuucugcggcgugaacagcgacaccgucgggugguccuggccggacggcgccgagcugcccuucacgaucgacaaguga

SEQ ID NO: 79866 - RNA, 1410 nt, Artificial Sequence; identical to SEQ ID NO: 78100
  derived and/or modified sequence opt1 from neuraminidase__InfluenzaA__ADI24592

SEQ ID NO: 79867 - RNA, 1410 nt, Artificial Sequence; identical to SEQ ID NO: 77746
  derived and/or modified sequence opt1 from neuraminidase__InfluenzaA__ADI24598

SEQ ID NO: 79868 - RNA, 1410 nt, Artificial Sequence; identical to SEQ ID NO: 77746
  derived and/or modified sequence opt1 from neuraminidase__InfluenzaA__ADI24604

SEQ ID NO: 79869 - RNA, 1410 nt, Artificial Sequence; identical to SEQ ID NO: 77746
  derived and/or modified sequence opt1 from neuraminidase__InfluenzaA__ADI24620

SEQ ID NO: 79870 - RNA, 1410 nt, Artificial Sequence; identical to SEQ ID NO: 77746
  derived and/or modified sequence opt1 from neuraminidase__InfluenzaA__ADI24622

SEQ ID NO: 79871 - RNA, 1410 nt, Artificial Sequence; identical to SEQ ID NO: 78100
  derived and/or modified sequence opt1 from neuraminidase__InfluenzaA__ADI46780

SEQ ID NO: 79872 - RNA, 1410 nt, Artificial Sequence
  derived and/or modified sequence opt1 from neuraminidase__InfluenzaA__ADI46789
augaaccccaaccagaagaucaucaccaucggcagcgugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacgagcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccgggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 79873 - RNA, 1410 nt, Artificial Sequence; identical to SEQ ID NO: 77746
  derived and/or modified sequence opt1 from neuraminidase__InfluenzaA__ADI48185

SEQ ID NO: 79874 - RNA, 1410 nt, Artificial Sequence; identical to SEQ ID NO: 77746
  derived and/or modified sequence opt1 from neuraminidase__InfluenzaA__ADI48187

SEQ ID NO: 79875 - RNA, 1410 nt, Artificial Sequence; identical to SEQ ID NO: 77746
  derived and/or modified sequence opt1 from neuraminidase__InfluenzaA__ADI48189

SEQ ID NO: 79876 - RNA, 1410 nt, Artificial Sequence; identical to SEQ ID NO: 77746
  derived and/or modified sequence opt1 from neuraminidase__InfluenzaA__ADI48191

SEQ ID NO: 79877 - RNA, 1410 nt, Artificial Sequence; identical to SEQ ID NO: 77746
  derived and/or modified sequence opt1 from neuraminidase__InfluenzaA__ADI48193

SEQ ID NO: 79878 - RNA, 1410 nt, Artificial Sequence; identical to SEQ ID NO: 77746
  derived and/or modified sequence opt1 from neuraminidase__InfluenzaA__ADI48195

SEQ ID NO: 79879 - RNA, 1410 nt, Artificial Sequence
  derived and/or modified sequence opt1 from neuraminidase__InfluenzaA__ADI48197
augaaccccaaccagaagaucaucaccaucggcagcgugugcaugaccaucgggauggccaaccugauccuccagaucggcaacaucaucuccaucuggaucagccacuccauccaguucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 79880 - RNA, 1410 nt, Artificial Sequence; identical to SEQ ID NO: 77746
  derived and/or modified sequence opt1 from neuraminidase__InfluenzaA__ADI48199

SEQ ID NO: 79881 - RNA, 1410 nt, Artificial Sequence; identical to SEQ ID NO: 77746
  derived and/or modified sequence opt1 from neuraminidase__InfluenzaA__ADI48201

SEQ ID NO: 79882 - RNA, 1410 nt, Artificial Sequence; identical to SEQ ID NO: 77746
  derived and/or modified sequence opt1 from neuraminidase__InfluenzaA__ADI48203

SEQ ID NO: 79883 - RNA, 1410 nt, Artificial Sequence
  derived and/or modified sequence opt1 from neuraminidase__InfluenzaA__ADI48205
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcucccaccuggagugccgcaccuucuuccugacccagggcgcccuccugaacgacaagcacagcaacgggaccaucaaggaccggucccccuaccgcacgcugaugagcugccccaucggcgaggucccgucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 79884 - RNA, 1410 nt, Artificial Sequence; identical to SEQ ID NO: 77746
  derived and/or modified sequence opt1 from neuraminidase__InfluenzaA__ADI48207

SEQ ID NO: 79885 - RNA, 1410 nt, Artificial Sequence; identical to SEQ ID NO: 77746
  derived and/or modified sequence opt1 from neuraminidase__InfluenzaA__ADI48209

SEQ ID NO: 79886 - RNA, 1410 nt, Artificial Sequence; identical to SEQ ID NO: 77746
  derived and/or modified sequence opt1 from neuraminidase__InfluenzaA__ADI48211

SEQ ID NO: 79887 - RNA, 1410 nt, Artificial Sequence; identical to SEQ ID NO: 77746
  derived and/or modified sequence opt1 from neuraminidase__InfluenzaA__ADI48213

SEQ ID NO: 79888 - RNA, 1410 nt, Artificial Sequence; identical to SEQ ID NO: 77746
  derived and/or modified sequence opt1 from neuraminidase__InfluenzaA__ADI48215

SEQ ID NO: 79889 - RNA, 1410 nt, Artificial Sequence; identical to SEQ ID NO: 77746
  derived and/or modified sequence opt1 from neuraminidase__InfluenzaA__ADI48217

SEQ ID NO: 79890 - RNA, 1410 nt, Artificial Sequence; identical to SEQ ID NO: 77746
  derived and/or modified sequence opt1 from neuraminidase__InfluenzaA__ADI48219

SEQ ID NO: 79891 - RNA, 1410 nt, Artificial Sequence; identical to SEQ ID NO: 77746
  derived and/or modified sequence opt1 from neuraminidase__InfluenzaA__ADI48221

SEQ ID NO: 79892 - RNA, 1410 nt, Artificial Sequence; identical to SEQ ID NO: 77746
  derived and/or modified sequence opt1 from neuraminidase__InfluenzaA__ADI48625

SEQ ID NO: 79893 - RNA, 1410 nt, Artificial Sequence; identical to SEQ ID NO: 77746
  derived and/or modified sequence opt1 from neuraminidase__InfluenzaA__ADI48635

SEQ ID NO: 79894 - RNA, 1410 nt, Artificial Sequence; identical to SEQ ID NO: 77746
  derived and/or modified sequence opt1 from neuraminidase__InfluenzaA__ADI48655

SEQ ID NO: 79895 - RNA, 1410 nt, Artificial Sequence; identical to SEQ ID NO: 77746
  derived and/or modified sequence opt1 from neuraminidase__InfluenzaA__ADI48665

SEQ ID NO: 79896 - RNA, 1410 nt, Artificial Sequence
  derived and/or modified sequence opt1 from neuraminidase__InfluenzaA__ADI48675
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccugaaggagaacaccaucuggaccagcggguccagcaucuccuucugcggcgugaacagcgacaccgucgggugguccuggcccgacggcgccgagcugcccuucacgaucgacaaguga

SEQ ID NO: 79897 - RNA, 1410 nt, Artificial Sequence
  derived and/or modified sequence opt1 from neuraminidase__InfluenzaA__ADI48685
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacggggccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 79898 - RNA, 1410 nt, Artificial Sequence; identical to SEQ ID NO: 77746
  derived and/or modified sequence opt1 from neuraminidase__InfluenzaA__ADI48695

SEQ ID NO: 79899 - RNA, 1410 nt, Artificial Sequence; identical to SEQ ID NO: 77736
  derived and/or modified sequence opt1 from neuraminidase__InfluenzaA__ADI48705

SEQ ID NO: 79900 - RNA, 1410 nt, Artificial Sequence; identical to SEQ ID NO: 77746
  derived and/or modified sequence opt1 from neuraminidase__InfluenzaA__ADI48715

SEQ ID NO: 79901 - RNA, 1410 nt, Artificial Sequence; identical to SEQ ID NO: 77746
  derived and/or modified sequence opt1 from neuraminidase__InfluenzaA__ADI48725

SEQ ID NO: 79902 - RNA, 1410 nt, Artificial Sequence; identical to SEQ ID NO: 77746
  derived and/or modified sequence opt1 from neuraminidase__InfluenzaA__ADI48735

SEQ ID NO: 79903 - RNA, 1410 nt, Artificial Sequence; identical to SEQ ID NO: 77746
  derived and/or modified sequence opt1 from neuraminidase__InfluenzaA__ADI48745

SEQ ID NO: 79904 - RNA, 1410 nt, Artificial Sequence
  derived and/or modified sequence opt1 from neuraminidase__InfluenzaA__ADI48755
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucagcgacaccaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 79905 - RNA, 1410 nt, Artificial Sequence; identical to SEQ ID NO: 77746
  derived and/or modified sequence opt1 from neuraminidase__InfluenzaA__ADI48765

SEQ ID NO: 79906 - RNA, 1410 nt, Artificial Sequence; identical to SEQ ID NO: 77746
  derived and/or modified sequence opt1 from neuraminidase__InfluenzaA__ADI48775

SEQ ID NO: 79907 - RNA, 1410 nt, Artificial Sequence; identical to SEQ ID NO: 77746
  derived and/or modified sequence opt1 from neuraminidase__InfluenzaA__ADI48785

SEQ ID NO: 79908 - RNA, 1410 nt, Artificial Sequence; identical to SEQ ID NO: 77746
  derived and/or modified sequence opt1 from neuraminidase__InfluenzaA__ADI48795

SEQ ID NO: 79909 - RNA, 1410 nt, Artificial Sequence; identical to SEQ ID NO: 77746
  derived and/or modified sequence opt1 from neuraminidase__InfluenzaA__ADI49032

SEQ ID NO: 79910 - RNA, 1410 nt, Artificial Sequence; identical to SEQ ID NO: 77746
  derived and/or modified sequence opt1 from neuraminidase__InfluenzaA__ADI49243

SEQ ID NO: 79911 - RNA, 1410 nt, Artificial Sequence; identical to SEQ ID NO: 77746
  derived and/or modified sequence opt1 from neuraminidase__InfluenzaA__ADI49263

SEQ ID NO: 79912 - RNA, 1410 nt, Artificial Sequence; identical to SEQ ID NO: 77746
  derived and/or modified sequence opt1 from neuraminidase__InfluenzaA__ADI49273

SEQ ID NO: 79913 - RNA, 1410 nt, Artificial Sequence; identical to SEQ ID NO: 77746
  derived and/or modified sequence opt1 from neuraminidase__InfluenzaA__ADI49283

SEQ ID NO: 79914 - RNA, 1410 nt, Artificial Sequence; identical to SEQ ID NO: 77746
  derived and/or modified sequence opt1 from neuraminidase__InfluenzaA__ADI49315

SEQ ID NO: 79915 - RNA, 1410 nt, Artificial Sequence; identical to SEQ ID NO: 77746
  derived and/or modified sequence opt1 from neuraminidase__InfluenzaA__ADI49325

SEQ ID NO: 79916 - RNA, 1410 nt, Artificial Sequence; identical to SEQ ID NO: 77746
  derived and/or modified sequence opt1 from neuraminidase__InfluenzaA__ADI49335

SEQ ID NO: 79917 - RNA, 1410 nt, Artificial Sequence
  derived and/or modified sequence opt1 from neuraminidase__InfluenzaA__ADI49345
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgacguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79918 - RNA, 1410 nt, Artificial Sequence; identical to SEQ ID NO: 77746
  derived and/or modified sequence opt1 from neuraminidase__InfluenzaA__ADI49355

SEQ ID NO: 79919 - RNA, 1410 nt, Artificial Sequence; identical to SEQ ID NO: 77746
  derived and/or modified sequence opt1 from neuraminidase__InfluenzaA__ADI49365

SEQ ID NO: 79920 - RNA, 1410 nt, Artificial Sequence; identical to SEQ ID NO: 77746
  derived and/or modified sequence opt1 from neuraminidase__InfluenzaA__ADI49375

SEQ ID NO: 79921 - RNA, 1410 nt, Artificial Sequence; identical to SEQ ID NO: 77746
  derived and/or modified sequence opt1 from neuraminidase__InfluenzaA__ADI49385

SEQ ID NO: 79922 - RNA, 1410 nt, Artificial Sequence
  derived and/or modified sequence opt1 from neuraminidase__InfluenzaA__ADI49395
augaaccccaaccagaagaucaucaccaucggcagcgugugcaugaccaucgggauggccaaccugauccuccagaucggcaacaugaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagcucaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79923 - RNA, 1410 nt, Artificial Sequence; identical to SEQ ID NO: 77746
  derived and/or modified sequence opt1 from neuraminidase__InfluenzaA__ADI49720

SEQ ID NO: 79924 - RNA, 1410 nt, Artificial Sequence; identical to SEQ ID NO: 77746
  derived and/or modified sequence opt1 from neuraminidase__InfluenzaA__ADI49730

SEQ ID NO: 79925 - RNA, 1410 nt, Artificial Sequence; identical to SEQ ID NO: 77746
  derived and/or modified sequence opt1 from neuraminidase__InfluenzaA__ADI49740

SEQ ID NO: 79926 - RNA, 1410 nt, Artificial Sequence; identical to SEQ ID NO: 77746
  derived and/or modified sequence opt1 from neuraminidase__InfluenzaA__ADI49750

SEQ ID NO: 79927 - RNA, 1410 nt, Artificial Sequence; identical to SEQ ID NO: 77746
  derived and/or modified sequence opt1 from neuraminidase__InfluenzaA__ADI49760

SEQ ID NO: 79928 - RNA, 1410 nt, Artificial Sequence; identical to SEQ ID NO: 77776
  derived and/or modified sequence opt1 from neuraminidase__InfluenzaA__ADI49780

SEQ ID NO: 79929 - RNA, 1410 nt, Artificial Sequence; identical to SEQ ID NO: 77736
  derived and/or modified sequence opt1 from neuraminidase__InfluenzaA__ADI49790

SEQ ID NO: 79930 - RNA, 1410 nt, Artificial Sequence; identical to SEQ ID NO: 77746
  derived and/or modified sequence opt1 from neuraminidase__InfluenzaA__ADI49821

SEQ ID NO: 79931 - RNA, 1410 nt, Artificial Sequence; identical to SEQ ID NO: 77736
  derived and/or modified sequence opt1 from neuraminidase__InfluenzaA__ADI50029

SEQ ID NO: 79932 - RNA, 1410 nt, Artificial Sequence
  derived and/or modified sequence opt1 from neuraminidase__InfluenzaA__ADI52830
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgacgagcugccguucacgaucgacaaguga

SEQ ID NO: 79933 - RNA, 1410 nt, Artificial Sequence
  derived and/or modified sequence opt1 from neuraminidase__InfluenzaA__ADI52831
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcgugagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79934 - RNA, 1410 nt, Artificial Sequence; identical to SEQ ID NO: 77746
  derived and/or modified sequence opt1 from neuraminidase__InfluenzaA__ADI52832

SEQ ID NO: 79935 - RNA, 1410 nt, Artificial Sequence
  derived and/or modified sequence opt1 from neuraminidase__InfluenzaA__ADI52833
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggcccccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 79936 - RNA, 1413 nt, Artificial Sequence; identical to SEQ ID NO: 78469
  derived and/or modified sequence opt1 from neuraminidase__InfluenzaA__ADI75821

SEQ ID NO: 79937 - RNA, 1410 nt, Artificial Sequence; identical to SEQ ID NO: 78913
  derived and/or modified sequence opt1 from neuraminidase__InfluenzaA__ADI75832

SEQ ID NO: 79938 - RNA, 1413 nt, Artificial Sequence
  derived and/or modified sequence opt1 from neuraminidase__InfluenzaA__ADI75854
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 79939 - RNA, 1410 nt, Artificial Sequence
  derived and/or modified sequence opt1 from neuraminidase__InfluenzaA__ADI75876
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccguggugagcuccuacgucugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggugaucgagggguggagcaaccacaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgaccugaaccucaugccgaucuga

SEQ ID NO: 79940 - RNA, 1410 nt, Artificial Sequence; identical to SEQ ID NO: 78913
  derived and/or modified sequence opt1 from neuraminidase__InfluenzaA__ADI75887

SEQ ID NO: 79941 - RNA, 1413 nt, Artificial Sequence; identical to SEQ ID NO: 78469
  derived and/or modified sequence opt1 from neuraminidase__InfluenzaA__ADI75909

SEQ ID NO: 79942 - RNA, 1410 nt, Artificial Sequence; identical to SEQ ID NO: 79492
  derived and/or modified sequence opt1 from neuraminidase__InfluenzaA__ADI75920

SEQ ID NO: 79943 - RNA, 1413 nt, Artificial Sequence; identical to SEQ ID NO: 78469
  derived and/or modified sequence opt1 from neuraminidase__InfluenzaA__ADI77352

SEQ ID NO: 79944 - RNA, 1410 nt, Artificial Sequence; identical to SEQ ID NO: 77746
  derived and/or modified sequence opt1 from neuraminidase__InfluenzaA__ADI77363

SEQ ID NO: 79945 - RNA, 1410 nt, Artificial Sequence; identical to SEQ ID NO: 78923
  derived and/or modified sequence opt1 from neuraminidase__InfluenzaA__ADI99500

SEQ ID NO: 79946 - RNA, 1410 nt, Artificial Sequence
  derived and/or modified sequence opt1 from neuraminidase__InfluenzaA__ADI99553
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgacuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79947 - RNA, 1410 nt, Artificial Sequence
  derived and/or modified sequence opt1 from neuraminidase__InfluenzaA__ADI99563
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggaggugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 79948 - RNA, 1410 nt, Artificial Sequence; identical to SEQ ID NO: 79947
  derived and/or modified sequence opt1 from neuraminidase__InfluenzaA__ADI99573

SEQ ID NO: 79949 - RNA, 1410 nt, Artificial Sequence; identical to SEQ ID NO: 79947
  derived and/or modified sequence opt1 from neuraminidase__InfluenzaA__ADI99583

SEQ ID NO: 79950 - RNA, 1410 nt, Artificial Sequence; identical to SEQ ID NO: 79097
  derived and/or modified sequence opt1 from neuraminidase__InfluenzaA__ADI99593

SEQ ID NO: 79951 - RNA, 1410 nt, Artificial Sequence
  derived and/or modified sequence opt1 from neuraminidase__InfluenzaA__ADI99613
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 79952 - RNA, 1410 nt, Artificial Sequence
  derived and/or modified sequence opt1 from neuraminidase__InfluenzaA__ADI99623
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccaacgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 79953 - RNA, 1410 nt, Artificial Sequence; identical to SEQ ID NO: 79034
  derived and/or modified sequence opt1 from neuraminidase__InfluenzaA__ADI99633

SEQ ID NO: 79954 - RNA, 1410 nt, Artificial Sequence; identical to SEQ ID NO: 79097
  derived and/or modified sequence opt1 from neuraminidase__InfluenzaA__ADI99643

SEQ ID NO: 79955 - RNA, 1410 nt, Artificial Sequence; identical to SEQ ID NO: 77746
  derived and/or modified sequence opt1 from neuraminidase__InfluenzaA__ADI99653

SEQ ID NO: 79956 - RNA, 1410 nt, Artificial Sequence; identical to SEQ ID NO: 77746
  derived and/or modified sequence opt1 from neuraminidase__InfluenzaA__ADI99663

SEQ ID NO: 79957 - RNA, 1410 nt, Artificial Sequence; identical to SEQ ID NO: 77746
  derived and/or modified sequence opt1 from neuraminidase__InfluenzaA__ADI99673

SEQ ID NO: 79958 - RNA, 1410 nt, Artificial Sequence; identical to SEQ ID NO: 77746
  derived and/or modified sequence opt1 from neuraminidase__InfluenzaA__ADI99683

SEQ ID NO: 79959 - RNA, 1410 nt, Artificial Sequence; identical to SEQ ID NO: 79208
  derived and/or modified sequence opt1 from neuraminidase__InfluenzaA__ADI99703

SEQ ID NO: 79960 - RNA, 1410 nt, Artificial Sequence; identical to SEQ ID NO: 77746
  derived and/or modified sequence opt1 from neuraminidase__InfluenzaA__ADI99713

SEQ ID NO: 79961 - RNA, 1410 nt, Artificial Sequence; identical to SEQ ID NO: 77746
  derived and/or modified sequence opt1 from neuraminidase__InfluenzaA__ADI99723

SEQ ID NO: 79962 - RNA, 1410 nt, Artificial Sequence; identical to SEQ ID NO: 77746
  derived and/or modified sequence opt1 from neuraminidase__InfluenzaA__ADI99733

SEQ ID NO: 79963 - RNA, 1410 nt, Artificial Sequence; identical to SEQ ID NO: 77901
  derived and/or modified sequence opt1 from neuraminidase__InfluenzaA__ADJ00487

SEQ ID NO: 79964 - RNA, 1410 nt, Artificial Sequence; identical to SEQ ID NO: 77901
  derived and/or modified sequence opt1 from neuraminidase__InfluenzaA__ADJ00488

SEQ ID NO: 79965 - RNA, 1410 nt, Artificial Sequence; identical to SEQ ID NO: 77901
  derived and/or modified sequence opt1 from neuraminidase__InfluenzaA__ADJ00489

SEQ ID NO: 79966 - RNA, 1410 nt, Artificial Sequence; identical to SEQ ID NO: 77901
  derived and/or modified sequence opt1 from neuraminidase__InfluenzaA__ADJ00490

SEQ ID NO: 79967 - RNA, 1410 nt, Artificial Sequence; identical to SEQ ID NO: 77901
  derived and/or modified sequence opt1 from neuraminidase__InfluenzaA__ADJ00491

SEQ ID NO: 79968 - RNA, 1410 nt, Artificial Sequence; identical to SEQ ID NO: 77746
  derived and/or modified sequence opt1 from neuraminidase__InfluenzaA__ADJ18160

SEQ ID NO: 79969 - RNA, 1410 nt, Artificial Sequence; identical to SEQ ID NO: 77746
  derived and/or modified sequence opt1 from neuraminidase__InfluenzaA__ADJ18161

SEQ ID NO: 79970 - RNA, 1410 nt, Artificial Sequence
  derived and/or modified sequence opt1 from neuraminidase__InfluenzaA__ADJ18162
augauccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccggaagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79971 - RNA, 1410 nt, Artificial Sequence
  derived and/or modified sequence opt1 from neuraminidase__InfluenzaA__ADJ18164
augaaccccaagcagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcagcgucuccggcugggccaucuacagcaaggacaacuccauccgcaucggcagcaagggggacguguucgugauccgggagccguucaucuccugcagcccccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 79972 - RNA, 1410 nt, Artificial Sequence; identical to SEQ ID NO: 77746
  derived and/or modified sequence opt1 from neuraminidase__InfluenzaA__ADJ18166

SEQ ID NO: 79973 - RNA, 1410 nt, Artificial Sequence; identical to SEQ ID NO: 77746
  derived and/or modified sequence opt1 from neuraminidase__InfluenzaA__ADJ18168

SEQ ID NO: 79974 - RNA, 1410 nt, Artificial Sequence; identical to SEQ ID NO: 77746
  derived and/or modified sequence opt1 from neuraminidase__InfluenzaA__ADJ18170

SEQ ID NO: 79975 - RNA, 1410 nt, Artificial Sequence
  derived and/or modified sequence opt1 from neuraminidase__InfluenzaA__ADJ18172
augaaccccaaccagaagaucaucaccaucggcagcgugugcaugaccaucgggauggccaaccugauccuccgcaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuaccggaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79976 - RNA, 1410 nt, Artificial Sequence; identical to SEQ ID NO: 77746
  derived and/or modified sequence opt1 from neuraminidase__InfluenzaA__ADJ18174

SEQ ID NO: 79977 - RNA, 1410 nt, Artificial Sequence
  derived and/or modified sequence opt1 from neuraminidase__InfluenzaA__ADJ18176
augaaccccaaccagaagaucaucaccaucggcagcgugugcaugaccaucgggauggccaaccugauccuccagaucggcaacaucaucuccaucuggaucagccuguccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79978 - RNA, 1410 nt, Artificial Sequence; identical to SEQ ID NO: 77519
  derived and/or modified sequence opt1 from neuraminidase__InfluenzaA__ADJ37250

SEQ ID NO: 79979 - RNA, 1410 nt, Artificial Sequence
  derived and/or modified sequence opt1 from neuraminidase__InfluenzaA__ADJ37252
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaucgugcgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccgucgugagcugguccaaggacauccugcgcacccaggagagcgagugcgugugcaucaacgggaccugcacggucgugaugaccgacggguccgccagcggcaaggccgacaccaagauccucuucaucgaggagggcaagaucgugcacaccagcacgcuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggaccuacggcacggggagcuggccggacggcgccaacaucaaccugaugcccaucuga

SEQ ID NO: 79980 - RNA, 1410 nt, Artificial Sequence; identical to SEQ ID NO: 77746
  derived and/or modified sequence opt1 from neuraminidase__InfluenzaA__ADJ37263

SEQ ID NO: 79981 - RNA, 1410 nt, Artificial Sequence; identical to SEQ ID NO: 77736
  derived and/or modified sequence opt1 from neuraminidase__InfluenzaA__ADJ37273

SEQ ID NO: 79982 - RNA, 1410 nt, Artificial Sequence; identical to SEQ ID NO: 77746
  derived and/or modified sequence opt1 from neuraminidase__InfluenzaA__ADJ40447

SEQ ID NO: 79983 - RNA, 1410 nt, Artificial Sequence; identical to SEQ ID NO: 77746
  derived and/or modified sequence opt1 from neuraminidase__InfluenzaA__ADJ40457

SEQ ID NO: 79984 - RNA, 1410 nt, Artificial Sequence; identical to SEQ ID NO: 79097
  derived and/or modified sequence opt1 from neuraminidase__InfluenzaA__ADJ40467

SEQ ID NO: 79985 - RNA, 1410 nt, Artificial Sequence
  derived and/or modified sequence opt1 from neuraminidase__InfluenzaA__ADJ40477
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccauggggugguccuggcccgacggcgccgagcugccguucacgaucgacaaguga

SEQ ID NO: 79986 - RNA, 1410 nt, Artificial Sequence; identical to SEQ ID NO: 77746
  derived and/or modified sequence opt1 from neuraminidase__InfluenzaA__ADJ40487

SEQ ID NO: 79987 - RNA, 1410 nt, Artificial Sequence; identical to SEQ ID NO: 77746
  derived and/or modified sequence opt1 from neuraminidase__InfluenzaA__ADJ40507

SEQ ID NO: 79988 - RNA, 1410 nt, Artificial Sequence; identical to SEQ ID NO: 77746
  derived and/or modified sequence opt1 from neuraminidase__InfluenzaA__ADJ40517

SEQ ID NO: 79989 - RNA, 1410 nt, Artificial Sequence; identical to SEQ ID NO: 77746
  derived and/or modified sequence opt1 from neuraminidase__InfluenzaA__ADJ40527

SEQ ID NO: 79990 - RNA, 1410 nt, Artificial Sequence
  derived and/or modified sequence opt1 from neuraminidase__InfluenzaA__ADJ40537
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcggggucuccgugaagcuggccggcaacagcucccucugcccggugagcggcugggccaucuacuccaaggacaacagcauccgcaucggguccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgagcgccugccacgacggcaucaacuggcucaccaucggcaucuccgggcccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacagcggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 79991 - RNA, 1410 nt, Artificial Sequence
  derived and/or modified sequence opt1 from neuraminidase__InfluenzaA__ADJ40547
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucaucaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucaucgggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 79992 - RNA, 1410 nt, Artificial Sequence; identical to SEQ ID NO: 77746
  derived and/or modified sequence opt1 from neuraminidase__InfluenzaA__ADJ40557

SEQ ID NO: 79993 - RNA, 1410 nt, Artificial Sequence; identical to SEQ ID NO: 77746
  derived and/or modified sequence opt1 from neuraminidase__InfluenzaA__ADJ40577

SEQ ID NO: 79994 - RNA, 1410 nt, Artificial Sequence; identical to SEQ ID NO: 77746
  derived and/or modified sequence opt1 from neuraminidase__InfluenzaA__ADJ40587

SEQ ID NO: 79995 - RNA, 1410 nt, Artificial Sequence
  derived and/or modified sequence opt1 from neuraminidase__InfluenzaA__ADJ40597
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuuccugaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 79996 - RNA, 1410 nt, Artificial Sequence; identical to SEQ ID NO: 77746
  derived and/or modified sequence opt1 from neuraminidase__InfluenzaA__ADJ40607

SEQ ID NO: 79997 - RNA, 1410 nt, Artificial Sequence; identical to SEQ ID NO: 77746
  derived and/or modified sequence opt1 from neuraminidase__InfluenzaA__ADJ40617

SEQ ID NO: 79998 - RNA, 1410 nt, Artificial Sequence; identical to SEQ ID NO: 78100
  derived and/or modified sequence opt1 from neuraminidase__InfluenzaA__ADJ40627

SEQ ID NO: 79999 - RNA, 1410 nt, Artificial Sequence; identical to SEQ ID NO: 77746
  derived and/or modified sequence opt1 from neuraminidase__InfluenzaA__ADJ40637

SEQ ID NO: 80000 - RNA, 1410 nt, Artificial Sequence; identical to SEQ ID NO: 77746
  derived and/or modified sequence opt1 from neuraminidase__InfluenzaA__ADJ40657

SEQ ID NO: 80001 - RNA, 1410 nt, Artificial Sequence; identical to SEQ ID NO: 77746
  derived and/or modified sequence opt1 from neuraminidase__InfluenzaA__ADJ40667

SEQ ID NO: 80002 - RNA, 1410 nt, Artificial Sequence; identical to SEQ ID NO: 77746
  derived and/or modified sequence opt1 from neuraminidase__InfluenzaA__ADJ40677

SEQ ID NO: 80003 - RNA, 1410 nt, Artificial Sequence
  derived and/or modified sequence opt1 from neuraminidase__InfluenzaA__ADJ41819
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugguccccugcgagcccaucaucaucgagcgcaacaucacggagaucguguaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggucacccgggagcccuacgugagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggucugcaucgccuggagcuccagcuccugccacgacggcaaggccuggcuccacgugugcaucacgggguacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagcuccagaucaaccgccaggugaucgucgacagcgggaaccgguccggcuacagcgggaucuucagcguggagggcaaguccugcaucaaccggugcuucuacguggagcugauccgcggccgcgagcaggagacccgggucugguggacgagcaacuccaucgugguguucugcgggaccagcggcaccuacgggaccggcuccuggcccgacggggccgacaucaaccugaugcccaucuga

SEQ ID NO: 80004 - RNA, 1410 nt, Artificial Sequence; identical to SEQ ID NO: 77746
  derived and/or modified sequence opt1 from neuraminidase__InfluenzaA__ADJ56642

SEQ ID NO: 80005 - RNA, 1410 nt, Artificial Sequence; identical to SEQ ID NO: 77746
  derived and/or modified sequence opt1 from neuraminidase__InfluenzaA__ADJ56652

SEQ ID NO: 80006 - RNA, 1410 nt, Artificial Sequence; identical to SEQ ID NO: 77746
  derived and/or modified sequence opt1 from neuraminidase__InfluenzaA__ADJ80637

SEQ ID NO: 80007 - RNA, 1410 nt, Artificial Sequence; identical to SEQ ID NO: 78764
  derived and/or modified sequence opt1 from neuraminidase__InfluenzaA__ADJ80647

SEQ ID NO: 80008 - RNA, 1410 nt, Artificial Sequence; identical to SEQ ID NO: 78764
  derived and/or modified sequence opt1 from neuraminidase__InfluenzaA__ADJ80657

SEQ ID NO: 80009 - RNA, 1410 nt, Artificial Sequence; identical to SEQ ID NO: 77746
  derived and/or modified sequence opt1 from neuraminidase__InfluenzaA__ADJ80667

SEQ ID NO: 80010 - RNA, 1410 nt, Artificial Sequence; identical to SEQ ID NO: 79659
  derived and/or modified sequence opt1 from neuraminidase__InfluenzaA__ADJ80677

SEQ ID NO: 80011 - RNA, 1410 nt, Artificial Sequence; identical to SEQ ID NO: 79034
  derived and/or modified sequence opt1 from neuraminidase__InfluenzaA__ADJ80687

SEQ ID NO: 80012 - RNA, 1410 nt, Artificial Sequence
  derived and/or modified sequence opt1 from neuraminidase__InfluenzaA__ADJ80697
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80013 - RNA, 1410 nt, Artificial Sequence
  derived and/or modified sequence opt1 from neuraminidase__InfluenzaA__ADJ80717
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccguguacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80014 - RNA, 1410 nt, Artificial Sequence
  derived and/or modified sequence opt1 from neuraminidase__InfluenzaA__ADJ80727
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggugaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80015 - RNA, 1410 nt, Artificial Sequence; identical to SEQ ID NO: 78513
  derived and/or modified sequence opt1 from neuraminidase__InfluenzaA__ADJ80737

SEQ ID NO: 80016 - RNA, 1410 nt, Artificial Sequence
  derived and/or modified sequence opt1 from neuraminidase__InfluenzaA__ADJ80747
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagcgggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcaucuucggggacaacccgcgccccaacgacaagaagggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggagaucaacgaguggagcggguacuccggcagcuucgugcagcacccggagcugaccgggcuggacugcauccggcccugcuucugggucgagcucauccgcggccggcccaaggagaacacgaucuggaccuccggcagcuccaucagcuucugcggggugaacuccgacaccgucggcuggagcuggcccgacggggccgagcugccguucaccaucgacaaguga

SEQ ID NO: 80017 - RNA, 1410 nt, Artificial Sequence; identical to SEQ ID NO: 77746
  derived and/or modified sequence opt1 from neuraminidase__InfluenzaA__ADJ80757

SEQ ID NO: 80018 - RNA, 1410 nt, Artificial Sequence; identical to SEQ ID NO: 77746
  derived and/or modified sequence opt1 from neuraminidase__InfluenzaA__ADJ80767

SEQ ID NO: 80019 - RNA, 1410 nt, Artificial Sequence; identical to SEQ ID NO: 78329
  derived and/or modified sequence opt1 from neuraminidase__InfluenzaA__ADJ80777

SEQ ID NO: 80020 - RNA, 1410 nt, Artificial Sequence; identical to SEQ ID NO: 77746
  derived and/or modified sequence opt1 from neuraminidase__InfluenzaA__ADJ80787

SEQ ID NO: 80021 - RNA, 1410 nt, Artificial Sequence
  derived and/or modified sequence opt1 from neuraminidase__InfluenzaA__ADJ80797
augaaccccaaccagaagaucaucaccaucggcagcgugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 80022 - RNA, 1410 nt, Artificial Sequence; identical to SEQ ID NO: 78764
  derived and/or modified sequence opt1 from neuraminidase__InfluenzaA__ADJ80807

SEQ ID NO: 80023 - RNA, 1410 nt, Artificial Sequence; identical to SEQ ID NO: 77746
  derived and/or modified sequence opt1 from neuraminidase__InfluenzaA__ADJ80817

SEQ ID NO: 80024 - RNA, 1410 nt, Artificial Sequence; identical to SEQ ID NO: 77746
  derived and/or modified sequence opt1 from neuraminidase__InfluenzaA__ADJ80827

SEQ ID NO: 80025 - RNA, 1410 nt, Artificial Sequence; identical to SEQ ID NO: 79259
  derived and/or modified sequence opt1 from neuraminidase__InfluenzaA__ADJ80837

SEQ ID NO: 80026 - RNA, 1410 nt, Artificial Sequence; identical to SEQ ID NO: 79757
  derived and/or modified sequence opt1 from neuraminidase__InfluenzaA__ADJ80851

SEQ ID NO: 80027 - RNA, 1410 nt, Artificial Sequence
  derived and/or modified sequence opt1 from neuraminidase__InfluenzaA__ADJ80861
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugucccccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 80028 - RNA, 1410 nt, Artificial Sequence; identical to SEQ ID NO: 80021
  derived and/or modified sequence opt1 from neuraminidase__InfluenzaA__ADJ80871

SEQ ID NO: 80029 - RNA, 1410 nt, Artificial Sequence; identical to SEQ ID NO: 77746
  derived and/or modified sequence opt1 from neuraminidase__InfluenzaA__ADJ80886

SEQ ID NO: 80030 - RNA, 1410 nt, Artificial Sequence
  derived and/or modified sequence opt1 from neuraminidase__InfluenzaA__ADJ80896
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcugaccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcgucgccugguccgccagcgcgugccacgacgggaucaacuggcucaccaucggcaucuccggccccgacaacggggccguggccgugcugaaguacaacggcaucaucaccgacacgaucaagagcuggcgcaacaacauccugcggacccaggaguccgagugcgccugcgucaacgggagcugcuucaccgugaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 80031 - RNA, 1410 nt, Artificial Sequence
  derived and/or modified sequence opt1 from neuraminidase__InfluenzaA__ADJ80913
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccgguccggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 80032 - RNA, 1410 nt, Artificial Sequence; identical to SEQ ID NO: 77746
  derived and/or modified sequence opt1 from neuraminidase__InfluenzaA__ADJ80930

SEQ ID NO: 80033 - RNA, 1410 nt, Artificial Sequence; identical to SEQ ID NO: 77746
  derived and/or modified sequence opt1 from neuraminidase__InfluenzaA__ADJ80950

SEQ ID NO: 80034 - RNA, 1410 nt, Artificial Sequence; identical to SEQ ID NO: 79034
  derived and/or modified sequence opt1 from neuraminidase__InfluenzaA__ADJ80960

SEQ ID NO: 80035 - RNA, 1410 nt, Artificial Sequence; identical to SEQ ID NO: 80021
  derived and/or modified sequence opt1 from neuraminidase__InfluenzaA__ADJ80970

SEQ ID NO: 80036 - RNA, 1410 nt, Artificial Sequence; identical to SEQ ID NO: 77746
  derived and/or modified sequence opt1 from neuraminidase__InfluenzaA__ADJ80980

SEQ ID NO: 80037 - RNA, 1410 nt, Artificial Sequence; identical to SEQ ID NO: 80021
  derived and/or modified sequence opt1 from neuraminidase__InfluenzaA__ADJ80996

SEQ ID NO: 80038 - RNA, 1410 nt, Artificial Sequence
  derived and/or modified sequence opt1 from neuraminidase__InfluenzaA__ADJ81006
augaaccccaaccagaagaucaucaccaucggcagcgugugcaugaccaucgggauggccaaccugauccuccaggucggcaacaucaucuccaucuggaucagccacuccauccagcuggggaaccagaaccagaucgagacgugcaaccagagcaucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaccagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80039 - RNA, 1410 nt, Artificial Sequence; identical to SEQ ID NO: 79757
  derived and/or modified sequence opt1 from neuraminidase__InfluenzaA__ADJ81016

SEQ ID NO: 80040 - RNA, 1410 nt, Artificial Sequence; identical to SEQ ID NO: 79946
  derived and/or modified sequence opt1 from neuraminidase__InfluenzaA__ADJ81026

SEQ ID NO: 80041 - RNA, 1410 nt, Artificial Sequence; identical to SEQ ID NO: 77746
  derived and/or modified sequence opt1 from neuraminidase__InfluenzaA__ADJ81036

SEQ ID NO: 80042 - RNA, 1410 nt, Artificial Sequence
  derived and/or modified sequence opt1 from neuraminidase__InfluenzaA__ADJ81046
augaaccccaaccagaagaucaucaccaucggcagcgugugcaugaccgucgggauggccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucaacagccggaacggcuucgagaugaucugggaccccaacggguggaccggcaccgacaacaacuucuccaucaagcaggacaucguggggacgaacgaguggagcggcuacuccgggagcuucguccagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 80043 - RNA, 1410 nt, Artificial Sequence
  derived and/or modified sequence opt1 from neuraminidase__InfluenzaA__ADJ81056
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccggguccagcucccucugccccgucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgagguccccucccccuacaacagccgguucgagagcguggccugguccgcgagcgccugccacgacgggaucaacuggcucaccaucggcaucuccggcccggacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaagggcagcugcggccccguguccagcaacggggccaacggcgugaagggguucuccuucaaguacggcaacggggucuggaucggccgcaccaagagcaucaacagccggaacggcuucgagaugaucugggacccgaacggguggaccggcaccgacaacaacuucuccaucaagcaggacaucguggggaucaacgaguggagcggcuacuccgggagcuucgugcagcaccccgagcugaccggccuggacugcauccgccccugcuucugggucgagcucauccggggccgccccaaggagaacacgaucuggaccuccgggagcuccaucagcuucugcggcgugaacuccgacaccgucggguggagcuggccggacggcgccgagcugcccuucaccaucgacaaguga

SEQ ID NO: 80044 - RNA, 1410 nt, Artificial Sequence; identical to SEQ ID NO: 79034
  derived and/or modified sequence opt1 from neuraminidase__InfluenzaA__ADJ81066

SEQ ID NO: 80045 - RNA, 1410 nt, Artificial Sequence; identical to SEQ ID NO: 77607
  derived and/or modified sequence opt1 from neuraminidase__InfluenzaA__ADJ84775

SEQ ID NO: 80046 - RNA, 1410 nt, Artificial Sequence
  derived and/or modified sequence opt1 from neuraminidase__InfluenzaA__ADJ88785
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccgucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccacaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggcccgacggcgccgaccugaaccucaugccgaucuga

SEQ ID NO: 80047 - RNA, 1410 nt, Artificial Sequence; identical to SEQ ID NO: 77746
  derived and/or modified sequence opt1 from neuraminidase__InfluenzaA__ADK21716

SEQ ID NO: 80048 - RNA, 1410 nt, Artificial Sequence; identical to SEQ ID NO: 77746
  derived and/or modified sequence opt1 from neuraminidase__InfluenzaA__ADK21726

SEQ ID NO: 80049 - RNA, 1410 nt, Artificial Sequence; identical to SEQ ID NO: 77746
  derived and/or modified sequence opt1 from neuraminidase__InfluenzaA__ADK21736

SEQ ID NO: 80050 - RNA, 1410 nt, Artificial Sequence
  derived and/or modified sequence opt1 from neuraminidase__InfluenzaA__ADK21746
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagcacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggagcggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccgaggagaacaccaucuggaccuccgggagcuccaucagcuucugcggcgucaacuccgacaccgugggguggagcuggcccgacggcgccgagcugccguucacgaucgacaaguga

SEQ ID NO: 80051 - RNA, 1410 nt, Artificial Sequence; identical to SEQ ID NO: 77746
  derived and/or modified sequence opt1 from neuraminidase__InfluenzaA__ADK21756

SEQ ID NO: 80052 - RNA, 1410 nt, Artificial Sequence; identical to SEQ ID NO: 77746
  derived and/or modified sequence opt1 from neuraminidase__InfluenzaA__ADK21766

SEQ ID NO: 80053 - RNA, 1410 nt, Artificial Sequence; identical to SEQ ID NO: 79177
  derived and/or modified sequence opt1 from neuraminidase__InfluenzaA__ADK21776

SEQ ID NO: 80054 - RNA, 1410 nt, Artificial Sequence; identical to SEQ ID NO: 77746
  derived and/or modified sequence opt1 from neuraminidase__InfluenzaA__ADK21786

SEQ ID NO: 80055 - RNA, 1410 nt, Artificial Sequence; identical to SEQ ID NO: 77746
  derived and/or modified sequence opt1 from neuraminidase__InfluenzaA__ADK21796

SEQ ID NO: 80056 - RNA, 1410 nt, Artificial Sequence; identical to SEQ ID NO: 77746
  derived and/or modified sequence opt1 from neuraminidase__InfluenzaA__ADK21806

SEQ ID NO: 80057 - RNA, 1410 nt, Artificial Sequence; identical to SEQ ID NO: 77746
  derived and/or modified sequence opt1 from neuraminidase__InfluenzaA__ADK21816

SEQ ID NO: 80058 - RNA, 1410 nt, Artificial Sequence; identical to SEQ ID NO: 79724
  derived and/or modified sequence opt1 from neuraminidase__InfluenzaA__ADK21826

SEQ ID NO: 80059 - RNA, 1410 nt, Artificial Sequence; identical to SEQ ID NO: 79637
  derived and/or modified sequence opt1 from neuraminidase__InfluenzaA__ADK21836

SEQ ID NO: 80060 - RNA, 1410 nt, Artificial Sequence
  derived and/or modified sequence opt1 from neuraminidase__InfluenzaA__ADK21846
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaugaagcaggacaucguggggaucaacgagugguccggcuacagcggguccuucgugcagcacccggagcugacgggccuggacugcauccgccccugcuucugggucgagcucauccggggccgccccaaggagaacaccaucugggccagcggguccagcaucuccuucugcggcgugaacagcgacaccgucgggugguccuggcccgacggcgcggagcugccguucaccaucgacaaguga

SEQ ID NO: 80061 - RNA, 1410 nt, Artificial Sequence; identical to SEQ ID NO: 77746
  derived and/or modified sequence opt1 from neuraminidase__InfluenzaA__ADK21856

SEQ ID NO: 80062 - RNA, 1410 nt, Artificial Sequence; identical to SEQ ID NO: 77746
  derived and/or modified sequence opt1 from neuraminidase__InfluenzaA__ADK21866

SEQ ID NO: 80063 - RNA, 1410 nt, Artificial Sequence; identical to SEQ ID NO: 77746
  derived and/or modified sequence opt1 from neuraminidase__InfluenzaA__ADK21876

SEQ ID NO: 80064 - RNA, 1410 nt, Artificial Sequence; identical to SEQ ID NO: 77746
  derived and/or modified sequence opt1 from neuraminidase__InfluenzaA__ADK21886

SEQ ID NO: 80065 - RNA, 1410 nt, Artificial Sequence
  derived and/or modified sequence opt1 from neuraminidase__InfluenzaA__ADK21896
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugagcuccgacacggucggguggagcuggcccgacggcgccgagcugccguucaccaucgacaaguga

SEQ ID NO: 80066 - RNA, 1410 nt, Artificial Sequence
  derived and/or modified sequence opt1 from neuraminidase__InfluenzaA__ADK21906
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccuggaucagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucggcagccggaacggguucgagaugaucugggaccccaacggcuggaccgggaccgacaacaacuucuccaucaagcaggacaucgucggcaucaacgaguggagcggguacuccggcagcuucgugcagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 80067 - RNA, 1410 nt, Artificial Sequence; identical to SEQ ID NO: 77746
  derived and/or modified sequence opt1 from neuraminidase__InfluenzaA__ADK21916

SEQ ID NO: 80068 - RNA, 1410 nt, Artificial Sequence; identical to SEQ ID NO: 77746
  derived and/or modified sequence opt1 from neuraminidase__InfluenzaA__ADK21926

SEQ ID NO: 80069 - RNA, 1410 nt, Artificial Sequence; identical to SEQ ID NO: 77746
  derived and/or modified sequence opt1 from neuraminidase__InfluenzaA__ADK21936

SEQ ID NO: 80070 - RNA, 1410 nt, Artificial Sequence
  derived and/or modified sequence opt1 from neuraminidase__InfluenzaA__ADK21946
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggcauggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80071 - RNA, 1410 nt, Artificial Sequence
  derived and/or modified sequence opt1 from neuraminidase__InfluenzaA__ADK21956
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcaacaccgucgggugguccuggcccgacggcgccgagcugccguucacgaucgacaaguga

SEQ ID NO: 80072 - RNA, 1410 nt, Artificial Sequence; identical to SEQ ID NO: 77746
  derived and/or modified sequence opt1 from neuraminidase__InfluenzaA__ADK32393

SEQ ID NO: 80073 - RNA, 1410 nt, Artificial Sequence; identical to SEQ ID NO: 77746
  derived and/or modified sequence opt1 from neuraminidase__InfluenzaA__ADK32403

SEQ ID NO: 80074 - RNA, 1410 nt, Artificial Sequence; identical to SEQ ID NO: 77746
  derived and/or modified sequence opt1 from neuraminidase__InfluenzaA__ADK32413

SEQ ID NO: 80075 - RNA, 1410 nt, Artificial Sequence
  derived and/or modified sequence opt1 from neuraminidase__InfluenzaA__ADK32423
augaaccccaaccagaagaucaucaccaucggcagcgugugcaugaccaucgggaugacgaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgccggccagagcgucguguccgugaagcuggcggggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80076 - RNA, 1410 nt, Artificial Sequence; identical to SEQ ID NO: 77746
  derived and/or modified sequence opt1 from neuraminidase__InfluenzaA__ADK32433

SEQ ID NO: 80077 - RNA, 1410 nt, Artificial Sequence; identical to SEQ ID NO: 77746
  derived and/or modified sequence opt1 from neuraminidase__InfluenzaA__ADK32443

SEQ ID NO: 80078 - RNA, 1410 nt, Artificial Sequence
  derived and/or modified sequence opt1 from neuraminidase__InfluenzaA__ADK32453
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugagcgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgccugcgugaacggguccugcuucaccgucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 80079 - RNA, 1410 nt, Artificial Sequence
  derived and/or modified sequence opt1 from neuraminidase__InfluenzaA__ADK32463
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccucaucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80080 - RNA, 1410 nt, Artificial Sequence; identical to SEQ ID NO: 77746
  derived and/or modified sequence opt1 from neuraminidase__InfluenzaA__ADK32473

SEQ ID NO: 80081 - RNA, 1410 nt, Artificial Sequence; identical to SEQ ID NO: 77746
  derived and/or modified sequence opt1 from neuraminidase__InfluenzaA__ADK32483

SEQ ID NO: 80082 - RNA, 1410 nt, Artificial Sequence; identical to SEQ ID NO: 77746
  derived and/or modified sequence opt1 from neuraminidase__InfluenzaA__ADK32493

SEQ ID NO: 80083 - RNA, 1410 nt, Artificial Sequence; identical to SEQ ID NO: 79659
  derived and/or modified sequence opt1 from neuraminidase__InfluenzaA__ADK32505

SEQ ID NO: 80084 - RNA, 1410 nt, Artificial Sequence
  derived and/or modified sequence opt1 from neuraminidase__InfluenzaA__ADK32640
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 80085 - RNA, 1410 nt, Artificial Sequence; identical to SEQ ID NO: 77746
  derived and/or modified sequence opt1 from neuraminidase__InfluenzaA__ADK32650

SEQ ID NO: 80086 - RNA, 1410 nt, Artificial Sequence; identical to SEQ ID NO: 77746
  derived and/or modified sequence opt1 from neuraminidase__InfluenzaA__ADK32660

SEQ ID NO: 80087 - RNA, 1410 nt, Artificial Sequence; identical to SEQ ID NO: 77746
  derived and/or modified sequence opt1 from neuraminidase__InfluenzaA__ADK32670

SEQ ID NO: 80088 - RNA, 1410 nt, Artificial Sequence
  derived and/or modified sequence opt1 from neuraminidase__InfluenzaA__ADK32680
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacaagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80089 - RNA, 1410 nt, Artificial Sequence; identical to SEQ ID NO: 77746
  derived and/or modified sequence opt1 from neuraminidase__InfluenzaA__ADK32690

SEQ ID NO: 80090 - RNA, 1410 nt, Artificial Sequence; identical to SEQ ID NO: 77746
  derived and/or modified sequence opt1 from neuraminidase__InfluenzaA__ADK32700

SEQ ID NO: 80091 - RNA, 1410 nt, Artificial Sequence; identical to SEQ ID NO: 77746
  derived and/or modified sequence opt1 from neuraminidase__InfluenzaA__ADK32779

SEQ ID NO: 80092 - RNA, 1410 nt, Artificial Sequence; identical to SEQ ID NO: 77746
  derived and/or modified sequence opt1 from neuraminidase__InfluenzaA__ADK33614

SEQ ID NO: 80093 - RNA, 1410 nt, Artificial Sequence; identical to SEQ ID NO: 77746
  derived and/or modified sequence opt1 from neuraminidase__InfluenzaA__ADK33624

SEQ ID NO: 80094 - RNA, 1410 nt, Artificial Sequence; identical to SEQ ID NO: 77746
  derived and/or modified sequence opt1 from neuraminidase__InfluenzaA__ADK33634

SEQ ID NO: 80095 - RNA, 1410 nt, Artificial Sequence
  derived and/or modified sequence opt1 from neuraminidase__InfluenzaA__ADK33644
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggcagcgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 80096 - RNA, 1410 nt, Artificial Sequence; identical to SEQ ID NO: 79477
  derived and/or modified sequence opt1 from neuraminidase__InfluenzaA__ADK33654

SEQ ID NO: 80097 - RNA, 1410 nt, Artificial Sequence; identical to SEQ ID NO: 79477
  derived and/or modified sequence opt1 from neuraminidase__InfluenzaA__ADK33664

SEQ ID NO: 80098 - RNA, 1410 nt, Artificial Sequence; identical to SEQ ID NO: 77746
  derived and/or modified sequence opt1 from neuraminidase__InfluenzaA__ADK33674

SEQ ID NO: 80099 - RNA, 1410 nt, Artificial Sequence; identical to SEQ ID NO: 77746
  derived and/or modified sequence opt1 from neuraminidase__InfluenzaA__ADK33684

SEQ ID NO: 80100 - RNA, 1410 nt, Artificial Sequence; identical to SEQ ID NO: 79097
  derived and/or modified sequence opt1 from neuraminidase__InfluenzaA__ADK33694

SEQ ID NO: 80101 - RNA, 1410 nt, Artificial Sequence; identical to SEQ ID NO: 77746
  derived and/or modified sequence opt1 from neuraminidase__InfluenzaA__ADK33704

SEQ ID NO: 80102 - RNA, 1410 nt, Artificial Sequence; identical to SEQ ID NO: 77746
  derived and/or modified sequence opt1 from neuraminidase__InfluenzaA__ADK33714

SEQ ID NO: 80103 - RNA, 1410 nt, Artificial Sequence; identical to SEQ ID NO: 77746
  derived and/or modified sequence opt1 from neuraminidase__InfluenzaA__ADK33744

SEQ ID NO: 80104 - RNA, 1410 nt, Artificial Sequence
  derived and/or modified sequence opt1 from neuraminidase__InfluenzaA__ADK33754
augaaccccaaccagaagaucaucaccaucggcagcgugugcaugaccaucgggauggccaacuucauccugcagaucggcaacaucaucuccaucuggaucagccacuccauccagcucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80105 - RNA, 1410 nt, Artificial Sequence
  derived and/or modified sequence opt1 from neuraminidase__InfluenzaA__ADK33764
augaaccccaaccagaagaucaucaccaucggcagcgugugcaugaccaucgggauggccaacuucauccugcagaucggcaacaucaucuccaucuggaucagccacuccauccagcucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaugggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80106 - RNA, 1410 nt, Artificial Sequence
  derived and/or modified sequence opt1 from neuraminidase__InfluenzaA__ADK33774
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaugggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80107 - RNA, 1410 nt, Artificial Sequence; identical to SEQ ID NO: 78720
  derived and/or modified sequence opt1 from neuraminidase__InfluenzaA__ADK33784

SEQ ID NO: 80108 - RNA, 1410 nt, Artificial Sequence; identical to SEQ ID NO: 77746
  derived and/or modified sequence opt1 from neuraminidase__InfluenzaA__ADK33794

SEQ ID NO: 80109 - RNA, 1410 nt, Artificial Sequence; identical to SEQ ID NO: 77746
  derived and/or modified sequence opt1 from neuraminidase__InfluenzaA__ADK33804

SEQ ID NO: 80110 - RNA, 1410 nt, Artificial Sequence
  derived and/or modified sequence opt1 from neuraminidase__InfluenzaA__ADK33814
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaacaagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaugggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80111 - RNA, 1410 nt, Artificial Sequence
  derived and/or modified sequence opt1 from neuraminidase__InfluenzaA__ADK33824
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacaucaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80112 - RNA, 1410 nt, Artificial Sequence; identical to SEQ ID NO: 78923
  derived and/or modified sequence opt1 from neuraminidase__InfluenzaA__ADK33834

SEQ ID NO: 80113 - RNA, 1410 nt, Artificial Sequence
  derived and/or modified sequence opt1 from neuraminidase__InfluenzaA__ADK33844
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacagcccgcucugccccguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgaggugcccagccccuacaacucccgguucgagagcgucgcguggagcgccuccgccugccacgacgggaucaacuggcucaccaucggcaucagcggcccggacaacggggccguggcggugcugaaguacaacggcaucaucaccgacaccaucaaguccuggcgcaacaacauccugcggacgcaggagagcgagugcgccugcgucaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccguggguguccuucaaccagaaccucgaguaccagaucggguacaucugcagcggcaucuucggggacaacccccggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggacccgaacggguggaccggcaccgacaacaacuucuccaucaagcaggacaucgucgggaucaacgaguggagcggcuacuccgggagcuucgugcagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgcggagcugcccuucacgaucgacaaguga

SEQ ID NO: 80114 - RNA, 1410 nt, Artificial Sequence; identical to SEQ ID NO: 78923
  derived and/or modified sequence opt1 from neuraminidase__InfluenzaA__ADK33854

SEQ ID NO: 80115 - RNA, 1410 nt, Artificial Sequence; identical to SEQ ID NO: 79637
  derived and/or modified sequence opt1 from neuraminidase__InfluenzaA__ADK33864

SEQ ID NO: 80116 - RNA, 1410 nt, Artificial Sequence
  derived and/or modified sequence opt1 from neuraminidase__InfluenzaA__ADK33874
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguaccugugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80117 - RNA, 1410 nt, Artificial Sequence; identical to SEQ ID NO: 77746
  derived and/or modified sequence opt1 from neuraminidase__InfluenzaA__ADK33884

SEQ ID NO: 80118 - RNA, 1410 nt, Artificial Sequence; identical to SEQ ID NO: 78923
  derived and/or modified sequence opt1 from neuraminidase__InfluenzaA__ADK33894

SEQ ID NO: 80119 - RNA, 1410 nt, Artificial Sequence; identical to SEQ ID NO: 78923
  derived and/or modified sequence opt1 from neuraminidase__InfluenzaA__ADK33904

SEQ ID NO: 80120 - RNA, 1410 nt, Artificial Sequence; identical to SEQ ID NO: 79703
  derived and/or modified sequence opt1 from neuraminidase__InfluenzaA__ADK33914

SEQ ID NO: 80121 - RNA, 1410 nt, Artificial Sequence
  derived and/or modified sequence opt1 from neuraminidase__InfluenzaA__ADK33924
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcaacaccgucgggugguccuggcccgacggcgccgagcugccguucacgaucgacaaguga

SEQ ID NO: 80122 - RNA, 1410 nt, Artificial Sequence; identical to SEQ ID NO: 77746
  derived and/or modified sequence opt1 from neuraminidase__InfluenzaA__ADK33934

SEQ ID NO: 80123 - RNA, 1410 nt, Artificial Sequence; identical to SEQ ID NO: 77746
  derived and/or modified sequence opt1 from neuraminidase__InfluenzaA__ADK33944

SEQ ID NO: 80124 - RNA, 1410 nt, Artificial Sequence; identical to SEQ ID NO: 79703
  derived and/or modified sequence opt1 from neuraminidase__InfluenzaA__ADK33954

SEQ ID NO: 80125 - RNA, 1410 nt, Artificial Sequence; identical to SEQ ID NO: 77746
  derived and/or modified sequence opt1 from neuraminidase__InfluenzaA__ADK33964

SEQ ID NO: 80126 - RNA, 1410 nt, Artificial Sequence; identical to SEQ ID NO: 78853
  derived and/or modified sequence opt1 from neuraminidase__InfluenzaA__ADK33974

SEQ ID NO: 80127 - RNA, 1410 nt, Artificial Sequence; identical to SEQ ID NO: 77746
  derived and/or modified sequence opt1 from neuraminidase__InfluenzaA__ADK33984

SEQ ID NO: 80128 - RNA, 1410 nt, Artificial Sequence
  derived and/or modified sequence opt1 from neuraminidase__InfluenzaA__ADK39016
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccgacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80129 - RNA, 1410 nt, Artificial Sequence; identical to SEQ ID NO: 77607
  derived and/or modified sequence opt1 from neuraminidase__InfluenzaA__ADK45315

SEQ ID NO: 80130 - RNA, 1410 nt, Artificial Sequence
  derived and/or modified sequence opt1 from neuraminidase__InfluenzaA__ADK45413
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcuguacgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgccagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccaacaucaaccugaugcccaucuga

SEQ ID NO: 80131 - RNA, 1410 nt, Artificial Sequence
  derived and/or modified sequence opt1 from neuraminidase__InfluenzaA__ADK45424
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuaccugugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 80132 - RNA, 1410 nt, Artificial Sequence; identical to SEQ ID NO: 78913
  derived and/or modified sequence opt1 from neuraminidase__InfluenzaA__ADK45446

SEQ ID NO: 80133 - RNA, 1410 nt, Artificial Sequence
  derived and/or modified sequence opt1 from neuraminidase__InfluenzaA__ADK45457
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcggguccagccacugccucgaccccaacaacgaggagggcgggcacggcgucaaggggugggccuucgacgacggcaacgacguguggaugggccgcaccaucuccgagaagucccggcugggguacgagaccuucaaggucaucgagggcuggagcaaccccaagagcaagcugcagaucaaccgccaggugaucguggaccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggaccagcggcacguacgggaccggcuccuggccggacggggccgacaucaaccugaugcccaucuga

SEQ ID NO: 80134 - RNA, 1410 nt, Artificial Sequence
  derived and/or modified sequence opt1 from neuraminidase__InfluenzaA__ADK45479
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagguggugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccacaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggaggccgagguccuguggaccuccaacagcaucgugguguucugcggcaccuccgggaccuacggcacggggagcuggcccgacggcgccgaccugaaccucaugccgaucuga

SEQ ID NO: 80135 - RNA, 1410 nt, Artificial Sequence; identical to SEQ ID NO: 77746
  derived and/or modified sequence opt1 from neuraminidase__InfluenzaA__ADK48799

SEQ ID NO: 80136 - RNA, 1410 nt, Artificial Sequence; identical to SEQ ID NO: 79659
  derived and/or modified sequence opt1 from neuraminidase__InfluenzaA__ADK62686

SEQ ID NO: 80137 - RNA, 1410 nt, Artificial Sequence; identical to SEQ ID NO: 79097
  derived and/or modified sequence opt1 from neuraminidase__InfluenzaA__ADK62696

SEQ ID NO: 80138 - RNA, 1410 nt, Artificial Sequence; identical to SEQ ID NO: 78329
  derived and/or modified sequence opt1 from neuraminidase__InfluenzaA__ADK64994

SEQ ID NO: 80139 - RNA, 1410 nt, Artificial Sequence
  derived and/or modified sequence opt1 from neuraminidase__InfluenzaA__ADK65002
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaccggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccggccugaaguacaacgggaucaucaccgacacgaucaagagcuggcgcaacaacauccugcggacccaggaguccgagugcgcgugcgucaacggcagcugcuucaccgugaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaacggguucgagaugaucugggaccccaacggcuggaccgggacggacaacaacuucagcaucaagcaggacaucgucggcaucaacgagugguccggguacagcggcuccuucgugcagcacccggagcugaccggccuggacugcauccgccccugcuucuggguggagcucauccgggggcgccccaaggagaacaccaucuggaccagcggcuccagcaucuccuucugcggggucaacagcgacacggugggcugguccuggcccgacggcgccgagcugccguucaccaucgacaaguga

SEQ ID NO: 80140 - RNA, 1410 nt, Artificial Sequence; identical to SEQ ID NO: 77746
  derived and/or modified sequence opt1 from neuraminidase__InfluenzaA__ADK65010

SEQ ID NO: 80141 - RNA, 1410 nt, Artificial Sequence
  derived and/or modified sequence opt1 from neuraminidase__InfluenzaA__ADK65018
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccgguucgagagcguggccuggcccgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgugaaguccaucgagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcaucuucggggacaacccccggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucguccagcaccccgagcugacgggccuggacugcauccgccccugcuucuggguggagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 80142 - RNA, 1410 nt, Artificial Sequence
  derived and/or modified sequence opt1 from neuraminidase__InfluenzaA__ADK87290
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccuacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccguguga

SEQ ID NO: 80143 - RNA, 1410 nt, Artificial Sequence
  derived and/or modified sequence opt1 from neuraminidase__InfluenzaA__ADK87292
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgccugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccguguga

SEQ ID NO: 80144 - RNA, 1410 nt, Artificial Sequence
  derived and/or modified sequence opt1 from neuraminidase__InfluenzaA__ADK87294
augaaccccaaccagaagaucaucgccaucggcagcgugucccugaccaucagcaccaucugcuucuuccuccagaucgccauccugaucacgaccgucacccugcacuucaagcaguacgaguucaacuccccgcccaacaaccaggugaugcucugcgagcccaccaucaucgagcgcaacaucacggagaucguguaccugaccaacaccaccaucgagaaggagaucugccccaagcuggcggaguaccggaacuggagcaagccgcagugcgacaucacgggguucgcccccuucuccaaggacaacagcauccgccucuccgccggcggggacaucugggucacccgggagcccuacgugagcugcgaccccgacaagugcuaccaguucgcccugggccaggggaccacccugaacaacgugcacuccaacaacacgguccgcgaccggaccccguaccgcacccuccugaugaacgagcugggcgugcccuuccaccucggcaccaagcaggucugcaucgccuggagcuccagcuccugccgggacgggaaggcguggcugcacgugugcaucacgggcgacgacaagaacgccaccgccagcuucaucuacaacgggcgccugguggacuccguggucagcugguccaaggagauccuccggacccaggagagcgagugcgugugcaucaacgggaccugcacgguggucaugaccgacggcuccgccagcggcaaggcggacaccaagauccuguucaucgaggagggcaagaucgugcacaccagcacgcuguccgggagcgcccagcacguggaggagugcuccugcuacccccgcuaccccggcguccggugcgugugccgcgacaccgggaagggcagcaaccggccgaucguggacaucaacaucaaggaccacuccaucgucagcuccuacgugugcagcggccucgugggggacacgccccgcaagaacgacuccagcuccagcucccacugccuggaccccaacaacgaggagggcgggcacggcgucaaggggugggccuucgacgacggcaacgacguguggaugggccggaccaucagcgagaagucccgccugggguacgagaccuucaaggucaucgagggcuggagcaaccccaaguccaagcuccagaucaaccgccaggugaucguggaccgggggaaccggagcggcuacuccgggaucuucagcgucgagggcaagagcugcaucaaccgcugcuucuacguggagcugauccggggccgcaaggaggagaccgaggugcuguggaccuccaacaacaucgucguguucugcgggaccagcggcacguacgggaccggcuccuggccggacggggccgacaucaaccucaugcccguguga

SEQ ID NO: 80145 - RNA, 1410 nt, Artificial Sequence
  derived and/or modified sequence opt1 from neuraminidase__InfluenzaA__ADK87297
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaagaaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80146 - RNA, 1410 nt, Artificial Sequence
  derived and/or modified sequence opt1 from neuraminidase__InfluenzaA__ADK87299
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuucaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80147 - RNA, 1410 nt, Artificial Sequence
  derived and/or modified sequence opt1 from neuraminidase__InfluenzaA__ADK87301
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggccaugaccgacggguccgccagcggcaaggcggacaccaagauccucuucaucgaggagggcaagaucguccacacgagcacccuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 80148 - RNA, 1410 nt, Artificial Sequence; identical to SEQ ID NO: 77607
  derived and/or modified sequence opt1 from neuraminidase__InfluenzaA__ADK87303

SEQ ID NO: 80149 - RNA, 1410 nt, Artificial Sequence
  derived and/or modified sequence opt1 from neuraminidase__InfluenzaA__ADK87305
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgugggccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccguguga

SEQ ID NO: 80150 - RNA, 1410 nt, Artificial Sequence
  derived and/or modified sequence opt1 from neuraminidase__InfluenzaA__ADK87307
augaaccccaaccagaaggugaucaccaucggcagcgucucccugaccaucagcacgaucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucggccgggggaaccgcagcggcuacuccgggaucuucagcguggagggcaagagcugcaucaaccggugcuucuacguggagcucaucggcgggcgcaaggaggagaccgagguccuguggaccuccaacagcaucgugguguucugcggcaccuccgggacguacggcaccgggagcuggccggacggcgccgacaucaaccugaugcccgucuga

SEQ ID NO: 80151 - RNA, 1410 nt, Artificial Sequence
  derived and/or modified sequence opt1 from neuraminidase__InfluenzaA__ADK87312
augaaccccaaccagaccaucaucaccaucggcagcgugugcaugacgaucgggauggccaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucaucuccgugaagcuggccgggaacagcucccucugcccggugagcggcugggccaucuacuccaaggacaacaacauccgcaucggcagcaagggggacgucuucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgaggugcccagccccuacaacucccgguucgagagcgucgccuggagcgcguccgccugccacgacgggaucaacuggcucaccaucggcaucagcggccccgacaacggggccguggccgugcugaaguacaacggcaucaucaccgacacgaucaaguccuggcgcaacaacauccugcggacccaggagagcgagugcgcgugcgucaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 80152 - RNA, 1410 nt, Artificial Sequence
  derived and/or modified sequence opt1 from neuraminidase__InfluenzaA__ADK87314
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgaggggaacaucaccgagaucguguaccucaccaacaccacgaucgagaaggagaugugccccaagcuggccgaguaccgcaacuggagcaagccgcagugcgacaucaccggcuucgcgcccuucuccaaggacaacagcauccggcuguccgccgggggcgacaucugggucacccgcgagcccuacgugagcugcgaccccgacaagugcuaccaguucgcccucgggcagggcaccacgcugaacaacgugcacuccaacaacaccguccgggaccgcaccccguaccggacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccgccugguggacuccguggucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcaccuccagcggcuccgcgcagcacguggaggagugcagcugcuacccccgcuaccccgggguccggugcgugugccgcgacaacuggaagggcuccaaccggccgaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucuccgagaagucccgccucggguacgagaccuucaaggucaucgagggcuggagcaaccccaagagcaagcugcagaucaaccgccaggugaucguggaccgggggaaccgguccggcuacagcgggaucuucagcgucgagggcaaguccugcaucaaccgcugcuucuacguggagcugauccggggccgcaaggaggagaccgaggugcucuggaccagcaacuccaucgucguguucugcgggaccagcggcacguacgggaccggcuccuggccggacggggccgacaucaaccugaugcccguguga

SEQ ID NO: 80153 - RNA, 1410 nt, Artificial Sequence
  derived and/or modified sequence opt1 from neuraminidase__InfluenzaA__ADK87316
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagaucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80154 - RNA, 1410 nt, Artificial Sequence
  derived and/or modified sequence opt1 from neuraminidase__InfluenzaA__ADK87318
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcagcugggucgagcucauccggggccgccccaaggagaacaccaucuggaccuccgggagcuccaccagcuucugcggcgugaacuccgacacggucggguggagcuggcccgacggcgccgagcugccguucaccaucgacaaguga

SEQ ID NO: 80155 - RNA, 1410 nt, Artificial Sequence
  derived and/or modified sequence opt1 from neuraminidase__InfluenzaA__ADK87320
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugcaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80156 - RNA, 1410 nt, Artificial Sequence
  derived and/or modified sequence opt1 from neuraminidase__InfluenzaA__ADK87324
augaaccccaaccagaagaucaucaccaucggcagcgugucccugaccaucagcacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccggcaagugcuaccaguucgcccuggggcagggcaccacgcugaacaacgugcacuccaacaacaccguccgcgaccggaccccguaccgcacccuccugaugaacgagcugggcgugcccuuccaccucgggacgaagcaggucugcaucgccuggagcuccagcuccugccacgacggcaaggccuggcugcacgugugcaucaccggggacgacgagaacgcgaccgccagcuucaucuacaacggccggcugguggacuccguggucagcugguccaaggagauccuccgcacccaggagagcgagugcgugugcaucaacgggacgugcaccguggucaugaccgacggcuccgccagcggcaaggccgacaccaagauccuguucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccucgugggggacacgccccggaagaacgacuccagcuccagcucccacugccuggaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcuccagaucaaccgccaggugaucguggaccgggggaaccgcagcggcuacuccgggaucuucagcgucgagggcaagagcugcaucaaccggugcuucuacguggagcugauccgcggccggaaggaggagaccgaggugcuguggaccuccaacagcaucgucguguucugcgggaccuccggcacguacgggaccggcagcuggccggacggggccgacaucaaccucaugcccguguga

SEQ ID NO: 80157 - RNA, 1410 nt, Artificial Sequence
  derived and/or modified sequence opt1 from neuraminidase__InfluenzaA__ADK87327
augaaccccaaccagaagaucaugaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagcggucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccguguga

SEQ ID NO: 80158 - RNA, 1410 nt, Artificial Sequence; identical to SEQ ID NO: 77746
  derived and/or modified sequence opt1 from neuraminidase__InfluenzaA__ADK87329

SEQ ID NO: 80159 - RNA, 1410 nt, Artificial Sequence
  derived and/or modified sequence opt1 from neuraminidase__InfluenzaA__ADK87330
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucugggccagcggguccagcaucuccuucugcggcgugaacagcgacaccgucgggugguccuggcccgacggcgcggagcugccguucaccaucgacaaguga

SEQ ID NO: 80160 - RNA, 1410 nt, Artificial Sequence; identical to SEQ ID NO: 77746
  derived and/or modified sequence opt1 from neuraminidase__InfluenzaA__ADK87331

SEQ ID NO: 80161 - RNA, 1410 nt, Artificial Sequence
  derived and/or modified sequence opt1 from neuraminidase__InfluenzaA__ADK87332
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaagcacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80162 - RNA, 1410 nt, Artificial Sequence
  derived and/or modified sequence opt1 from neuraminidase__InfluenzaA__ADK87333
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccuacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80163 - RNA, 1410 nt, Artificial Sequence
  derived and/or modified sequence opt1 from neuraminidase__InfluenzaA__ADK87335
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgaccgccgguaccaguucgcccucggccaggggaccacgcugaacaacgugcacuccgacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggaacgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 80164 - RNA, 1410 nt, Artificial Sequence
  derived and/or modified sequence opt1 from neuraminidase__InfluenzaA__ADK87337
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacgccguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggaacgcccagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggaccuacggcacgggguccuggccggacggcgccgacaucaaccugaugcccaucuga

SEQ ID NO: 80165 - RNA, 1410 nt, Artificial Sequence
  derived and/or modified sequence opt1 from neuraminidase__InfluenzaA__ADK87339
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80166 - RNA, 1410 nt, Artificial Sequence; identical to SEQ ID NO: 77746
  derived and/or modified sequence opt1 from neuraminidase__InfluenzaA__ADK90209

SEQ ID NO: 80167 - RNA, 1410 nt, Artificial Sequence; identical to SEQ ID NO: 77746
  derived and/or modified sequence opt1 from neuraminidase__InfluenzaA__ADK90213

SEQ ID NO: 80168 - RNA, 1410 nt, Artificial Sequence; identical to SEQ ID NO: 77746
  derived and/or modified sequence opt1 from neuraminidase__InfluenzaA__ADK90217

SEQ ID NO: 80169 - RNA, 1410 nt, Artificial Sequence; identical to SEQ ID NO: 79725
  derived and/or modified sequence opt1 from neuraminidase__InfluenzaA__ADK90221

SEQ ID NO: 80170 - RNA, 1410 nt, Artificial Sequence; identical to SEQ ID NO: 79725
  derived and/or modified sequence opt1 from neuraminidase__InfluenzaA__ADK90225

SEQ ID NO: 80171 - RNA, 1410 nt, Artificial Sequence; identical to SEQ ID NO: 77746
  derived and/or modified sequence opt1 from neuraminidase__InfluenzaA__ADK90229

SEQ ID NO: 80172 - RNA, 1410 nt, Artificial Sequence; identical to SEQ ID NO: 77746
  derived and/or modified sequence opt1 from neuraminidase__InfluenzaA__ADK90233

SEQ ID NO: 80173 - RNA, 1410 nt, Artificial Sequence
  derived and/or modified sequence opt1 from neuraminidase__InfluenzaA__ADK90241
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacgccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggagcccccaccgcacccugauguccugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 80174 - RNA, 1410 nt, Artificial Sequence; identical to SEQ ID NO: 79725
  derived and/or modified sequence opt1 from neuraminidase__InfluenzaA__ADK90245

SEQ ID NO: 80175 - RNA, 1410 nt, Artificial Sequence
  derived and/or modified sequence opt1 from neuraminidase__InfluenzaA__ADK90249
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaugaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80176 - RNA, 1410 nt, Artificial Sequence; identical to SEQ ID NO: 80175
  derived and/or modified sequence opt1 from neuraminidase__InfluenzaA__ADK90253

SEQ ID NO: 80177 - RNA, 1410 nt, Artificial Sequence
  derived and/or modified sequence opt1 from neuraminidase__InfluenzaA__ADK90257
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggagcccccaccgcacccugauguccugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 80178 - RNA, 1410 nt, Artificial Sequence; identical to SEQ ID NO: 78100
  derived and/or modified sequence opt1 from neuraminidase__InfluenzaA__ADK90261

SEQ ID NO: 80179 - RNA, 1410 nt, Artificial Sequence
  derived and/or modified sequence opt1 from neuraminidase__InfluenzaA__ADK90265
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaugggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80180 - RNA, 1410 nt, Artificial Sequence
  derived and/or modified sequence opt1 from neuraminidase__InfluenzaA__ADK90269
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagaagugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccaucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccaucaucagcuucugcggcgucaacuccgacaccgugggguggagcuggcccgacggcgccgagcugccguucaccaucgacaaguga

SEQ ID NO: 80181 - RNA, 1410 nt, Artificial Sequence; identical to SEQ ID NO: 77746
  derived and/or modified sequence opt1 from neuraminidase__InfluenzaA__ADK90273

SEQ ID NO: 80182 - RNA, 1410 nt, Artificial Sequence; identical to SEQ ID NO: 77746
  derived and/or modified sequence opt1 from neuraminidase__InfluenzaA__ADK90277

SEQ ID NO: 80183 - RNA, 1410 nt, Artificial Sequence; identical to SEQ ID NO: 77746
  derived and/or modified sequence opt1 from neuraminidase__InfluenzaA__ADK90281

SEQ ID NO: 80184 - RNA, 1410 nt, Artificial Sequence
  derived and/or modified sequence opt1 from neuraminidase__InfluenzaA__ADK90289
augaaccccaaccagaagaucaucaccaucggcagcgugugcaugaccaucgggauggccaaccugauccuccagaucggcaacaucaucuccaucuggaucagccacuccauccagcuggggaaccagaaccugaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80185 - RNA, 1410 nt, Artificial Sequence; identical to SEQ ID NO: 79725
  derived and/or modified sequence opt1 from neuraminidase__InfluenzaA__ADK90293

SEQ ID NO: 80186 - RNA, 1410 nt, Artificial Sequence; identical to SEQ ID NO: 79637
  derived and/or modified sequence opt1 from neuraminidase__InfluenzaA__ADK90297

SEQ ID NO: 80187 - RNA, 1410 nt, Artificial Sequence; identical to SEQ ID NO: 77746
  derived and/or modified sequence opt1 from neuraminidase__InfluenzaA__ADK90301

SEQ ID NO: 80188 - RNA, 1410 nt, Artificial Sequence; identical to SEQ ID NO: 79637
  derived and/or modified sequence opt1 from neuraminidase__InfluenzaA__ADK90305

SEQ ID NO: 80189 - RNA, 1410 nt, Artificial Sequence; identical to SEQ ID NO: 77746
  derived and/or modified sequence opt1 from neuraminidase__InfluenzaA__ADK90309

SEQ ID NO: 80190 - RNA, 1410 nt, Artificial Sequence
  derived and/or modified sequence opt1 from neuraminidase__InfluenzaA__ADK90313
augaaccccaaccacaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80191 - RNA, 1410 nt, Artificial Sequence; identical to SEQ ID NO: 77746
  derived and/or modified sequence opt1 from neuraminidase__InfluenzaA__ADK90317

SEQ ID NO: 80192 - RNA, 1410 nt, Artificial Sequence; identical to SEQ ID NO: 79725
  derived and/or modified sequence opt1 from neuraminidase__InfluenzaA__ADK90321

SEQ ID NO: 80193 - RNA, 1410 nt, Artificial Sequence; identical to SEQ ID NO: 77746
  derived and/or modified sequence opt1 from neuraminidase__InfluenzaA__ADK90325

SEQ ID NO: 80194 - RNA, 1410 nt, Artificial Sequence
  derived and/or modified sequence opt1 from neuraminidase__InfluenzaA__ADK90329
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccgcagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacgaggccguggccguccugaaguacaacgggaucaucaccgacaccaucaagagcuggcggaacaacauccugcgcacgcaggaguccgagugcgcgugcgugaacggcagcugcuucaccgugaugaccgacgggccguccgacggccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 80195 - RNA, 1410 nt, Artificial Sequence
  derived and/or modified sequence opt1 from neuraminidase__InfluenzaA__ADK90333
augaaccccaaccagaagaucaucaccaucggcagcgugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80196 - RNA, 1410 nt, Artificial Sequence; identical to SEQ ID NO: 79725
  derived and/or modified sequence opt1 from neuraminidase__InfluenzaA__ADK90337

SEQ ID NO: 80197 - RNA, 1410 nt, Artificial Sequence; identical to SEQ ID NO: 78805
  derived and/or modified sequence opt1 from neuraminidase__InfluenzaA__ADK90341

SEQ ID NO: 80198 - RNA, 1410 nt, Artificial Sequence; identical to SEQ ID NO: 78805
  derived and/or modified sequence opt1 from neuraminidase__InfluenzaA__ADK90345

SEQ ID NO: 80199 - RNA, 1410 nt, Artificial Sequence; identical to SEQ ID NO: 78805
  derived and/or modified sequence opt1 from neuraminidase__InfluenzaA__ADK90349

SEQ ID NO: 80200 - RNA, 1410 nt, Artificial Sequence; identical to SEQ ID NO: 79725
  derived and/or modified sequence opt1 from neuraminidase__InfluenzaA__ADK90353

SEQ ID NO: 80201 - RNA, 1410 nt, Artificial Sequence; identical to SEQ ID NO: 77746
  derived and/or modified sequence opt1 from neuraminidase__InfluenzaA__ADK90357

SEQ ID NO: 80202 - RNA, 1410 nt, Artificial Sequence; identical to SEQ ID NO: 79725
  derived and/or modified sequence opt1 from neuraminidase__InfluenzaA__ADK90361

SEQ ID NO: 80203 - RNA, 1410 nt, Artificial Sequence; identical to SEQ ID NO: 78720
  derived and/or modified sequence opt1 from neuraminidase__InfluenzaA__ADK90365

SEQ ID NO: 80204 - RNA, 1410 nt, Artificial Sequence; identical to SEQ ID NO: 77746
  derived and/or modified sequence opt1 from neuraminidase__InfluenzaA__ADK90369

SEQ ID NO: 80205 - RNA, 1410 nt, Artificial Sequence; identical to SEQ ID NO: 77746
  derived and/or modified sequence opt1 from neuraminidase__InfluenzaA__ADK90373

SEQ ID NO: 80206 - RNA, 1410 nt, Artificial Sequence
  derived and/or modified sequence opt1 from neuraminidase__InfluenzaA__ADK90377
augaaccccaaccagaagaucaucaccaucggcagcgugugcaugaccaucgggaugacgaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgccggccagagcgucguguccgugaagcuggcggggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggagcccccaccgcacccugauguccugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagauggacgcccccaacuaccacuacgaggagugcagcugcuaccccgacuccagcgagaucaucugcgugugccgggacaacuggcacggcuccaaccgccccugggucagcuucaaccagaaccucgaguaccagaucggguacaucugcuccggcaucuucggggacaacccgcggcccaacgacaagacgggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80207 - RNA, 1410 nt, Artificial Sequence; identical to SEQ ID NO: 79725
  derived and/or modified sequence opt1 from neuraminidase__InfluenzaA__ADK90381

SEQ ID NO: 80208 - RNA, 1410 nt, Artificial Sequence
  derived and/or modified sequence opt1 from neuraminidase__InfluenzaA__ADK90385
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugagcgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccccaccgcacgcugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcacgugcgugaacggguccugcuucaccgugaugaccgacggcccgagcgacggccaggccuccuacaagaucuuccgcaucgagaaggggaagaucgucaagagcguggagaugaacgcgcccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 80209 - RNA, 1410 nt, Artificial Sequence; identical to SEQ ID NO: 77746
  derived and/or modified sequence opt1 from neuraminidase__InfluenzaA__ADK90389

SEQ ID NO: 80210 - RNA, 1410 nt, Artificial Sequence; identical to SEQ ID NO: 79725
  derived and/or modified sequence opt1 from neuraminidase__InfluenzaA__ADK90393

SEQ ID NO: 80211 - RNA, 1410 nt, Artificial Sequence; identical to SEQ ID NO: 79637
  derived and/or modified sequence opt1 from neuraminidase__InfluenzaA__ADK90397

SEQ ID NO: 80212 - RNA, 1410 nt, Artificial Sequence; identical to SEQ ID NO: 77746
  derived and/or modified sequence opt1 from neuraminidase__InfluenzaA__ADK90401

SEQ ID NO: 80213 - RNA, 1410 nt, Artificial Sequence
  derived and/or modified sequence opt1 from neuraminidase__InfluenzaA__ADK90405
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcacgugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80214 - RNA, 1410 nt, Artificial Sequence; identical to SEQ ID NO: 77746
  derived and/or modified sequence opt1 from neuraminidase__InfluenzaA__ADK90409

SEQ ID NO: 80215 - RNA, 1410 nt, Artificial Sequence
  derived and/or modified sequence opt1 from neuraminidase__InfluenzaA__ADK90413
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgagcgccugccacgacgggaucaacuggcucaccaucggcaucuccggccccgacaacggggccauggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80216 - RNA, 1410 nt, Artificial Sequence; identical to SEQ ID NO: 77746
  derived and/or modified sequence opt1 from neuraminidase__InfluenzaA__ADK90417

SEQ ID NO: 80217 - RNA, 1410 nt, Artificial Sequence; identical to SEQ ID NO: 77746
  derived and/or modified sequence opt1 from neuraminidase__InfluenzaA__ADK90421

SEQ ID NO: 80218 - RNA, 1410 nt, Artificial Sequence; identical to SEQ ID NO: 77746
  derived and/or modified sequence opt1 from neuraminidase__InfluenzaA__ADK90425

SEQ ID NO: 80219 - RNA, 1410 nt, Artificial Sequence; identical to SEQ ID NO: 77746
  derived and/or modified sequence opt1 from neuraminidase__InfluenzaA__ADK90429

SEQ ID NO: 80220 - RNA, 1410 nt, Artificial Sequence; identical to SEQ ID NO: 77607
  derived and/or modified sequence opt1 from neuraminidase__InfluenzaA__ADK94194

SEQ ID NO: 80221 - RNA, 1410 nt, Artificial Sequence; identical to SEQ ID NO: 77607
  derived and/or modified sequence opt1 from neuraminidase__InfluenzaA__ADK94205

SEQ ID NO: 80222 - RNA, 1410 nt, Artificial Sequence; identical to SEQ ID NO: 78913
  derived and/or modified sequence opt1 from neuraminidase__InfluenzaA__ADK94216

SEQ ID NO: 80223 - RNA, 1410 nt, Artificial Sequence; identical to SEQ ID NO: 77607
  derived and/or modified sequence opt1 from neuraminidase__InfluenzaA__ADK94227

SEQ ID NO: 80224 - RNA, 1410 nt, Artificial Sequence; identical to SEQ ID NO: 77607
  derived and/or modified sequence opt1 from neuraminidase__InfluenzaA__ADK94238

SEQ ID NO: 80225 - RNA, 1410 nt, Artificial Sequence; identical to SEQ ID NO: 80131
  derived and/or modified sequence opt1 from neuraminidase__InfluenzaA__ADK94260

SEQ ID NO: 80226 - RNA, 1410 nt, Artificial Sequence; identical to SEQ ID NO: 80131
  derived and/or modified sequence opt1 from neuraminidase__InfluenzaA__ADK94271

SEQ ID NO: 80227 - RNA, 1410 nt, Artificial Sequence; identical to SEQ ID NO: 77607
  derived and/or modified sequence opt1 from neuraminidase__InfluenzaA__ADK94293

SEQ ID NO: 80228 - RNA, 1410 nt, Artificial Sequence; identical to SEQ ID NO: 77607
  derived and/or modified sequence opt1 from neuraminidase__InfluenzaA__ADK94304

SEQ ID NO: 80229 - RNA, 1410 nt, Artificial Sequence
  derived and/or modified sequence opt1 from neuraminidase__InfluenzaA__ADK94326
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacauccacuccaacaacaccgugcgcgaccggaccccguaccgcacccugcucaugaacgagcugggcguccccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 80230 - RNA, 1410 nt, Artificial Sequence; identical to SEQ ID NO: 78913
  derived and/or modified sequence opt1 from neuraminidase__InfluenzaA__ADK94337

SEQ ID NO: 80231 - RNA, 1410 nt, Artificial Sequence; identical to SEQ ID NO: 77607
  derived and/or modified sequence opt1 from neuraminidase__InfluenzaA__ADK94444

SEQ ID NO: 80232 - RNA, 1410 nt, Artificial Sequence
  derived and/or modified sequence opt1 from neuraminidase__InfluenzaA__ADK94479
augaaccccaaccagaagaucaucaccaucggcagcgugucccugaccaucagcacgaucugcuuccucaugcagaucgccauccugaccaccaccgucacgcugcacuucaagcaguacgaguucaacuccccgcccaacaaccaggugaugcucugcgagcccaccaccaucgagcgcaacaucaccgagaucguguaccugacgaacaccaccaucgagaaggagaucugccccaagcuggccgaguaccggaacuggagcaagccgcagugcgacaucaccggguucgcgcccuucuccaaggacaacagcauccgccucuccgccggcggggacaucugggucacgcgggagcccuacgugagcugcgaccccgacaagugcuaccaguucgcccugggccaggggaccacccugaacaacgugcacuccaacaacaccguccgcgaccggacgccguaccgcacccuccugaugaacgagcugggcgugcccuuccaccucggcaccaagcaggucugcaucgccuggagcuccagcuccugccacgacgggaaggccuggcugcacgugugcaucaccggcgacgacaagaacgcgacggccagcuucaucuacaacgggaagcugguggacuccguggucagcugguccaaggagauccuccggacccaggagagcgagugcgugugcaucaacgggaccugcaccguggucaugacggacggguccgccagcggcaaggccgacaccaagauccuguucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuaccucugcagcggccuggugggcgacacgccccgcaagaacgacuccagcuccagcucccacugccuggaccccaacaacgaggagggcggccacggggugaagggcugggccuucgacgacgggaacgacgucuggaugggccggaccaucagcgagaagucccgccucggcuacgagaccuucaaggugaucgagggguggagcaaccccaaguccaagcugcagaucaaccggcaggucaucguggaccgcggcaaccggagcggguacuccggcaucuucagcguggagggcaagagcugcaucaaccgcugcuucuacgucgagcugauccgggggcgcaaggaggagaccggcgugcucuggacguccaacagcaucguggucuucugcgggaccuccggcaccuacgggaccggcagcuggccggacggggccgacaucaaccugaugcccaucuga

SEQ ID NO: 80233 - RNA, 1410 nt, Artificial Sequence; identical to SEQ ID NO: 77607
  derived and/or modified sequence opt1 from neuraminidase__InfluenzaA__ADK94490

SEQ ID NO: 80234 - RNA, 1410 nt, Artificial Sequence; identical to SEQ ID NO: 77607
  derived and/or modified sequence opt1 from neuraminidase__InfluenzaA__ADK94501

SEQ ID NO: 80235 - RNA, 1410 nt, Artificial Sequence
  derived and/or modified sequence opt1 from neuraminidase__InfluenzaA__ADK94512
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggccggaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 80236 - RNA, 1410 nt, Artificial Sequence; identical to SEQ ID NO: 77607
  derived and/or modified sequence opt1 from neuraminidase__InfluenzaA__ADK94534

SEQ ID NO: 80237 - RNA, 1410 nt, Artificial Sequence; identical to SEQ ID NO: 80131
  derived and/or modified sequence opt1 from neuraminidase__InfluenzaA__ADK94556

SEQ ID NO: 80238 - RNA, 1410 nt, Artificial Sequence; identical to SEQ ID NO: 77607
  derived and/or modified sequence opt1 from neuraminidase__InfluenzaA__ADK94567

SEQ ID NO: 80239 - RNA, 1410 nt, Artificial Sequence; identical to SEQ ID NO: 77607
  derived and/or modified sequence opt1 from neuraminidase__InfluenzaA__ADK94578

SEQ ID NO: 80240 - RNA, 1410 nt, Artificial Sequence; identical to SEQ ID NO: 77607
  derived and/or modified sequence opt1 from neuraminidase__InfluenzaA__ADK94589

SEQ ID NO: 80241 - RNA, 1410 nt, Artificial Sequence; identical to SEQ ID NO: 79297
  derived and/or modified sequence opt1 from neuraminidase__InfluenzaA__ADK98504

SEQ ID NO: 80242 - RNA, 1410 nt, Artificial Sequence
  derived and/or modified sequence opt1 from neuraminidase__InfluenzaA__ADK98506
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagaacgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80243 - RNA, 1410 nt, Artificial Sequence
  derived and/or modified sequence opt1 from neuraminidase__InfluenzaA__ADK98626
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaugaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuaccugugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 80244 - RNA, 1410 nt, Artificial Sequence; identical to SEQ ID NO: 78913
  derived and/or modified sequence opt1 from neuraminidase__InfluenzaA__ADK98637

SEQ ID NO: 80245 - RNA, 1410 nt, Artificial Sequence
  derived and/or modified sequence opt1 from neuraminidase__InfluenzaA__ADK98648
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcgcggggugaagggcugggccuucgacgacgggaacgacgucuggaugggccggaccaucagcgagaagucccgccugggcuacgagaccuucaaggugaucgagggguggagcaaccccaaguccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccaacaucaaccugaugcccaucuga

SEQ ID NO: 80246 - RNA, 1410 nt, Artificial Sequence
  derived and/or modified sequence opt1 from neuraminidase__InfluenzaA__ADK98659
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcgggcacugccucgaccccaacaacgaggagggcgggcacggcgucaaggggugggccuucgacgacggcaacgacguguggaugggccgcaccaucuccgagaagucccggcugggguacgagaccuucaaggucaucgagggcuggagcaaccacaagagcaagcugcagaucaaccgccaggugaucguggaccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggaccagcggcacguacgggaccggcuccuggcccgacggggccgaccugaaccucaugccgaucuga

SEQ ID NO: 80247 - RNA, 1410 nt, Artificial Sequence; identical to SEQ ID NO: 80131
  derived and/or modified sequence opt1 from neuraminidase__InfluenzaA__ADK98670

SEQ ID NO: 80248 - RNA, 1410 nt, Artificial Sequence
  derived and/or modified sequence opt1 from neuraminidase__InfluenzaA__ADK98681
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcgaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaccaaccgccaggugaucguggaccggggcaaccgcagcggguacuccggcaucuucagcgucgaggggaagaacugcaucaaccggugcuucuacguggagcucauccgcggccggaaggaggagaccgaggugcuguggaccagcaacuccaucgucguguucugcggcacgagcgggaccuacggcaccggguccuggccggacggcgccgacaucaaccugaugcccaucuga

SEQ ID NO: 80249 - RNA, 1410 nt, Artificial Sequence
  derived and/or modified sequence opt1 from neuraminidase__InfluenzaA__ADK98703
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcgaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaccaaccgccaggugaucguggaccggggcaaccgcagcggguacuccggcaucuucagcgucgaggggaagaacugcaucaaccggugcuucuacguggagcucauccgcggccggaaggaggagaccgaggugcuguggacgagcaacuccaucgucguguucugcggcaccagcgggaccuacggcaccggguccuggccggacggcgccgacaucaaccugaugcccaucuga

SEQ ID NO: 80250 - RNA, 1410 nt, Artificial Sequence; identical to SEQ ID NO: 79492
  derived and/or modified sequence opt1 from neuraminidase__InfluenzaA__ADK98725

SEQ ID NO: 80251 - RNA, 1410 nt, Artificial Sequence; identical to SEQ ID NO: 80131
  derived and/or modified sequence opt1 from neuraminidase__InfluenzaA__ADK98736

SEQ ID NO: 80252 - RNA, 1410 nt, Artificial Sequence
  derived and/or modified sequence opt1 from neuraminidase__InfluenzaA__ADK98747
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaugaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 80253 - RNA, 1410 nt, Artificial Sequence
  derived and/or modified sequence opt1 from neuraminidase__InfluenzaA__ADK98758
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccaacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 80254 - RNA, 1410 nt, Artificial Sequence; identical to SEQ ID NO: 79492
  derived and/or modified sequence opt1 from neuraminidase__InfluenzaA__ADK98769

SEQ ID NO: 80255 - RNA, 1410 nt, Artificial Sequence; identical to SEQ ID NO: 80046
  derived and/or modified sequence opt1 from neuraminidase__InfluenzaA__ADK98780

SEQ ID NO: 80256 - RNA, 1410 nt, Artificial Sequence; identical to SEQ ID NO: 79492
  derived and/or modified sequence opt1 from neuraminidase__InfluenzaA__ADK98791

SEQ ID NO: 80257 - RNA, 1410 nt, Artificial Sequence; identical to SEQ ID NO: 77607
  derived and/or modified sequence opt1 from neuraminidase__InfluenzaA__ADK98802

SEQ ID NO: 80258 - RNA, 1410 nt, Artificial Sequence
  derived and/or modified sequence opt1 from neuraminidase__InfluenzaA__ADK98813
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccgccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 80259 - RNA, 1410 nt, Artificial Sequence; identical to SEQ ID NO: 77607
  derived and/or modified sequence opt1 from neuraminidase__InfluenzaA__ADK98824

SEQ ID NO: 80260 - RNA, 1410 nt, Artificial Sequence; identical to SEQ ID NO: 79492
  derived and/or modified sequence opt1 from neuraminidase__InfluenzaA__ADK98835

SEQ ID NO: 80261 - RNA, 1410 nt, Artificial Sequence; identical to SEQ ID NO: 80131
  derived and/or modified sequence opt1 from neuraminidase__InfluenzaA__ADK98846

SEQ ID NO: 80262 - RNA, 1410 nt, Artificial Sequence
  derived and/or modified sequence opt1 from neuraminidase__InfluenzaA__ADK98857
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccacaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggcccgacggcgccaacaucaaccugaugccgaucuga

SEQ ID NO: 80263 - RNA, 1410 nt, Artificial Sequence
  derived and/or modified sequence opt1 from neuraminidase__InfluenzaA__ADK98868
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaacgaggugcuguggaccuccaacagcaucgucguguucugcggcaccuccgggaccuacggcacggggagcuggccggacggcgccgacaucaaccugaugcccaucuga

SEQ ID NO: 80264 - RNA, 1410 nt, Artificial Sequence
  derived and/or modified sequence opt1 from neuraminidase__InfluenzaA__ADK98879
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggccaugcugugcgagcccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacaacaccgugcgcgaccggaccccguaccgcacccugcucaugaacgagcugggcguccccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccguggugagcugguccaaggagauccugcgcacccaggagagcgagugcgucugcaucaacggcacgugcaccguggugaugaccgacggguccgccagcggcaaggcggacaccaagauccucuucaucgaggagggcaagaucguccacacgagcacccuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 80265 - RNA, 1410 nt, Artificial Sequence; identical to SEQ ID NO: 80131
  derived and/or modified sequence opt1 from neuraminidase__InfluenzaA__ADK98890

SEQ ID NO: 80266 - RNA, 1410 nt, Artificial Sequence; identical to SEQ ID NO: 79492
  derived and/or modified sequence opt1 from neuraminidase__InfluenzaA__ADK98901

SEQ ID NO: 80267 - RNA, 1410 nt, Artificial Sequence; identical to SEQ ID NO: 80046
  derived and/or modified sequence opt1 from neuraminidase__InfluenzaA__ADK98912

SEQ ID NO: 80268 - RNA, 1410 nt, Artificial Sequence; identical to SEQ ID NO: 80131
  derived and/or modified sequence opt1 from neuraminidase__InfluenzaA__ADK98923

SEQ ID NO: 80269 - RNA, 1410 nt, Artificial Sequence; identical to SEQ ID NO: 78913
  derived and/or modified sequence opt1 from neuraminidase__InfluenzaA__ADK98945

SEQ ID NO: 80270 - RNA, 1410 nt, Artificial Sequence
  derived and/or modified sequence opt1 from neuraminidase__InfluenzaA__ADK98956
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccgucgugagcuccuacgugugcagcggccuggucggcgacacgccccggaaguccgacagcuccagcuccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccacaagagcaagcugcagaucaaccgccaggugaucgucgaccggggcaaccgcuccggguacagcggcaucuucagcguggaggggaaguccugcaucaaccggugcuucuacguggagcucauccgcggccggaaggaggagaccgagguccuguggaccagcaacuccaucgugguguucugcggcaccagcgggacguacggcaccggguccuggcccgacggcgccgaccugaaccucaugccgaucuga

SEQ ID NO: 80271 - RNA, 1410 nt, Artificial Sequence; identical to SEQ ID NO: 79492
  derived and/or modified sequence opt1 from neuraminidase__InfluenzaA__ADK98967

SEQ ID NO: 80272 - RNA, 1410 nt, Artificial Sequence; identical to SEQ ID NO: 80131
  derived and/or modified sequence opt1 from neuraminidase__InfluenzaA__ADK98978

SEQ ID NO: 80273 - RNA, 1410 nt, Artificial Sequence; identical to SEQ ID NO: 80270
  derived and/or modified sequence opt1 from neuraminidase__InfluenzaA__ADK98989

SEQ ID NO: 80274 - RNA, 1410 nt, Artificial Sequence; identical to SEQ ID NO: 77607
  derived and/or modified sequence opt1 from neuraminidase__InfluenzaA__ADK99000

SEQ ID NO: 80275 - RNA, 1410 nt, Artificial Sequence; identical to SEQ ID NO: 80270
  derived and/or modified sequence opt1 from neuraminidase__InfluenzaA__ADK99011

SEQ ID NO: 80276 - RNA, 1410 nt, Artificial Sequence
  derived and/or modified sequence opt1 from neuraminidase__InfluenzaA__ADK99022
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgaccccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 80277 - RNA, 1410 nt, Artificial Sequence; identical to SEQ ID NO: 77607
  derived and/or modified sequence opt1 from neuraminidase__InfluenzaA__ADK99033

SEQ ID NO: 80278 - RNA, 1410 nt, Artificial Sequence
  derived and/or modified sequence opt1 from neuraminidase__InfluenzaA__ADK99044
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaagaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacggccacuccaacaacaccgugcgcgaccggaccccguaccgcacccugcucaugaacgagcugggcguccccuuccaccuggggacgaagcaggucugcaucgccuggagcuccagcuccugccacgacggcaaggccuggcuccacgugugcaucaccggggacgacaagaacgcgaccgccagcuucaucuacaacggcaagcugguggacuccguggugagcugguccaaggagauccugcggacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgcuaccccggggugcggugcgucugccgcgacaacuggaagggcagcaaccggccgaucguggacaucaacaucaaggaccacuccaucgugagcuccuacgucugcagcggccuggugggggacacgccccgcaagaacgacuccagcuccagcucccacugccucgaccccaacaacgaggagggcgggcacggcgugaaggggugggccuucgacgacggcaacgacgucuggaugggccggaccaucagcgagaagucccgccugggguacgagaccuucaaggugaucgagggcuggagcaaccacaaguccaagcugcagaucaaccggcaggucaucguggaccgcgggaaccggagcggcuacuccgggaucuucagcguggagggcaagagcugcaucaaccgcugcuucuacgucgagcucauccggggccgcaaggaggagaccgaggugcuguggaccuccaacagcaucguggucuucugcgggaccuccggcacguacgggaccggcagcuggcccgacggggccgaccugaaccucaugccgaucuga

SEQ ID NO: 80279 - RNA, 1410 nt, Artificial Sequence
  derived and/or modified sequence opt1 from neuraminidase__InfluenzaA__ADK99055
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 80280 - RNA, 1410 nt, Artificial Sequence
  derived and/or modified sequence opt1 from neuraminidase__InfluenzaA__ADK99066
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaagaagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuaccugugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccaacaucaaccucaugcccaucuga

SEQ ID NO: 80281 - RNA, 1410 nt, Artificial Sequence
  derived and/or modified sequence opt1 from neuraminidase__InfluenzaA__ADK99077
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagguggugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccacaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggcccgacggcgccgaccugaaccucaugccgaucuga

SEQ ID NO: 80282 - RNA, 1410 nt, Artificial Sequence; identical to SEQ ID NO: 80046
  derived and/or modified sequence opt1 from neuraminidase__InfluenzaA__ADK99088

SEQ ID NO: 80283 - RNA, 1410 nt, Artificial Sequence; identical to SEQ ID NO: 79492
  derived and/or modified sequence opt1 from neuraminidase__InfluenzaA__ADK99099

SEQ ID NO: 80284 - RNA, 1410 nt, Artificial Sequence
  derived and/or modified sequence opt1 from neuraminidase__InfluenzaA__ADK99110
augaaccccaaccagaagaucaucaccaucggcagcgugucccugaccaucagcacgaucugcuucuucaugcagaucgccauccucgucaccaccgugacccugcacuucaagcaguacgaguucaacccgccgcccaacaaccaggugaugcugugcgagcccacgaucaucgagcgcaacaucaccgagaucgucuaccucaccaacaccacgaucgagaaggagaucugcccgaagcuggccgaguaccggaacugguccaagccccagugcgacaucaccggguucgcgcccuucagcaaggacaacuccauccgccugagcgccggcggggacaucugggugacccgggagcccuacguguccugcgacccggacaagugcuaccaguucgcccucggccaggggaccacgcugaacaacguccacagcaacaacaccgugcgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcgucguguccuggagcaaggacauccugcgcacccaggaguccgagugcgugugcaucaacggcacgugcaccgucgugaugaccgacgggagcgccuccggcaaggccgacaccaagauccucuucaucgaggagggcaagaucgugcacacgagcacccugagcggguccgcgcagcacgucgaggagugcagcugcuacccccgguacccgggcgugcgcugcgugugccgggacaacuggaagggguccaaccgccccaucgucgacaucaacaucaaggaccacagcaucguguccagcuacgugugcuccggccuggucggcgacacgccccggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcaccagcgggacguacggcaccggguccuggcccgacggcgccaacaucaaccugaugcccaucuga

SEQ ID NO: 80285 - RNA, 1410 nt, Artificial Sequence; identical to SEQ ID NO: 80131
  derived and/or modified sequence opt1 from neuraminidase__InfluenzaA__ADK99121

SEQ ID NO: 80286 - RNA, 1410 nt, Artificial Sequence
  derived and/or modified sequence opt1 from neuraminidase__InfluenzaA__ADK99132
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuaccugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcuccagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcuguggaccuccaacagcaucgucguguucugcggcaccuccgggacguacggcaccgggagcuggccggacggcgccgacaucaaccucaugcccaucuga

SEQ ID NO: 80287 - RNA, 1410 nt, Artificial Sequence; identical to SEQ ID NO: 80131
  derived and/or modified sequence opt1 from neuraminidase__InfluenzaA__ADK99143

SEQ ID NO: 80288 - RNA, 1410 nt, Artificial Sequence; identical to SEQ ID NO: 77607
  derived and/or modified sequence opt1 from neuraminidase__InfluenzaA__ADK99154

SEQ ID NO: 80289 - RNA, 1410 nt, Artificial Sequence
  derived and/or modified sequence opt1 from neuraminidase__InfluenzaA__ADK99176
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccugaagcuggccgaguaccggaacuggagcaagccccagugcgacaucaccggguucgcgccguucuccaaggacaacagcauccgccucuccgccggcggggacaucugggugacccgggagcccuacgugagcugcgaccccgacaagugcuaccaguucgcccugggccaggggaccacgcugaacaacguccacuccaacaacaccgugcgcgaccggacccccuaccgcacccuccugaugaacgagcugggcgugccguuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccgucgugagcugguccaaggacauccuccgcacccaggagagcgagugcgugugcaucaacggcacgugcaccgucgugaugaccgacggguccgccagcggcaaggccgacaccaagauccuguucaucgaggagggcaagaucgugcacacgagcacccuguccgggagcgcgcagcacgucgaggagugcuccugcuacccccgguaccccggcgugcgcugcgugugccgggacaacuggaaggggagcaaccgccccaucgucgacaucaacaucaaggaccacuccaucgugagcuccuacgugugcagcggccucgucggcgacaccccgcggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagacguucaaggugaucgagggguggagcaaccccaaguccaagcuccagaucaaccgccaggugaucgucgaccggggcaaccgcagcggguacuccggcaucuucagcguggagggcaagagcugcaucaaccggugcuucuacguggagcugauccgcgggcggaaggaggagaccgagguccuguggaccuccaacagcaucgugguguucugcggcaccuccgggacguacggcaccgggagcuggcccgacggcgccaacaucaaccucaugccgaucuga

SEQ ID NO: 80290 - RNA, 1410 nt, Artificial Sequence; identical to SEQ ID NO: 80281
  derived and/or modified sequence opt1 from neuraminidase__InfluenzaA__ADK99187

SEQ ID NO: 80291 - RNA, 1410 nt, Artificial Sequence; identical to SEQ ID NO: 79492
  derived and/or modified sequence opt1 from neuraminidase__InfluenzaA__ADK99198

SEQ ID NO: 80292 - RNA, 1410 nt, Artificial Sequence; identical to SEQ ID NO: 80131
  derived and/or modified sequence opt1 from neuraminidase__InfluenzaA__ADK99220

SEQ ID NO: 80293 - RNA, 1410 nt, Artificial Sequence
  derived and/or modified sequence opt1 from neuraminidase__InfluenzaA__ADK99231
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaacugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuaccugugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 80294 - RNA, 1410 nt, Artificial Sequence
  derived and/or modified sequence opt1 from neuraminidase__InfluenzaA__ADK99242
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucaucgucuucugcggcaccuccgggacguacggcaccgggagcuggccggacggcgccgacaucaaccugaugcccaucuga

SEQ ID NO: 80295 - RNA, 1410 nt, Artificial Sequence
  derived and/or modified sequence opt1 from neuraminidase__InfluenzaA__ADK99253
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggccaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugacccucaugccgaucuga

SEQ ID NO: 80296 - RNA, 1410 nt, Artificial Sequence
  derived and/or modified sequence opt1 from neuraminidase__InfluenzaA__ADK99264
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuaccugugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccacaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 80297 - RNA, 1410 nt, Artificial Sequence
  derived and/or modified sequence opt1 from neuraminidase__InfluenzaA__ADK99275
augaaccccaaccagaagaucaucaccaucggcagcgugucccugaccaucagcacgaucugcuucuucaugcagaucgccguccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccggguaccggaacuggagcaagccgcagugcgacaucaccggcuucgcgcccuucuccaaggacaacagcauccgccuguccgccgggggcgacaucugggugacccgggagcccuacgugagcugcgaccccgacaagugcuaccaguucgcccucgggcagggcaccacgcugaacaacguccacuccaacgacaccgugcgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccgucgugagcugguccaaggagauccugcgcacccaggagagcgagugcgugugcaucaacgggacgugcaccgucgugaugaccgacggcuccgccagcggcaaggccgacaccaagauccucuucaucgaggaggggaagaucgugcacacgagcacccuguccggcagcgcgcagcacgucgaggagugcuccugcuacccccgguaccccggggugcgcugcgugugccgggacaacuggaagggcagcaaccgcccgaucgucgacaucaacaucaaggaccacuccaucgugagcuccuacgugugcagcggccuggucggggacacgccccggaagaacgacuccagcuccagcucccacugccucgaccccaacaacgaggagggcgggcacggcgugaaggggugggccuucgacgacggcaacgacgucuggaugggccgcaccaucaacgagaccagccggcugggguacgagaccuucaaggugaucgagggcugguccaaccccaagagcaagcugcagaucaaccgccaggugaucgucgaccgggggaaccgcuccggcuacagcgggaucuucuccguggagggcaagagcugcaucaaccggugcuucuacguggagcucauccgcggccggaaggaggagaccgagguccuguggaccagcaacuccaucgugguguucugcgggacgagcggcaccuacgggaccggcuccuggccggacggggccgaccugaaccucaugcccaucuga

SEQ ID NO: 80298 - RNA, 1410 nt, Artificial Sequence
  derived and/or modified sequence opt1 from neuraminidase__InfluenzaA__ADK99286
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugacgccccgcgagcccaccaucaucgagcggaacaucaccgagaucguguaccugaccaacacgaccaucgagaaggagaucugccccaagcucgccgaguaccgcaacugguccaagccccagugcgacaucaccggguucgcgcccuucagcaaggacaacuccauccggcugagcgccggcggggacaucugggucacccgcgagccguacguguccugcgaccccgacaagugcuaccaguucgcccugggccaggggacgacccucaacaacauccacagcaacaacaccgugcgggaccgcacccccuaccggacgcugcugaugaacgagcucggcguccccuuccaccugggcaccaagcaggucugcaucgccugguccagcuccagcugccacgacgggaaggccuggcugcacgugugcaucaccggcgacgacaagaacgcgaccgccuccuucaucuacaacgggcgccucguggacagcgugguguccuggagcaaggagauccugcggacgcaggaguccgagugcgucugcaucaacgggaccugcaccguggugaugaccgacgggagcgccuccggcaaggccgacacgaagauccuguucaucgaggagggcaagaucguccacaccagcacccucagcggguccgcgcagcacguggaggagugcagcugcuacccgcgcuaccccggcgugcggugcgucugccgcgacaacuggaagggguccaaccggcccaucguggacaucaacaucaaggaccacagcaucguguccagcuacgucugcuccggccuggugggcgacacgccccgcaagaacgacagcuccagcuccagccacugccuggacccgaacaacgaggagggcggccacggggugaagggcugggccuucgacgacgggaacgacgucuggaugggccggaccaucuccgagaagucccgccucggcuacgagaccuucaaggugaucgagggguggagcaaccccaagagcaagcugcagaucaaccggcaggucaucguggaccgcggcaaccgguccggguacagcggcaucuucuccguggagggcaagagcugcaucaaccgcugcuucuacgucgagcugauccgggggcgcaaggaggagaccgaggugcucuggaccagcaacuccaucguggucuucugcggcacgagcgggaccuacggcaccggguccuggcccgacggcgccgacaucaaccugaugcccaucuga

SEQ ID NO: 80299 - RNA, 1410 nt, Artificial Sequence; identical to SEQ ID NO: 78600
  derived and/or modified sequence opt1 from neuraminidase__InfluenzaA__ADK99297

SEQ ID NO: 80300 - RNA, 1410 nt, Artificial Sequence
  derived and/or modified sequence opt1 from neuraminidase__InfluenzaA__ADK99308
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcauccccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 80301 - RNA, 1413 nt, Artificial Sequence; identical to SEQ ID NO: 78469
  derived and/or modified sequence opt1 from neuraminidase__InfluenzaA__ADL14590

SEQ ID NO: 80302 - RNA, 1410 nt, Artificial Sequence; identical to SEQ ID NO: 79492
  derived and/or modified sequence opt1 from neuraminidase__InfluenzaA__ADL27992

SEQ ID NO: 80303 - RNA, 1410 nt, Artificial Sequence; identical to SEQ ID NO: 80131
  derived and/or modified sequence opt1 from neuraminidase__InfluenzaA__ADL28003

SEQ ID NO: 80304 - RNA, 1410 nt, Artificial Sequence; identical to SEQ ID NO: 80276
  derived and/or modified sequence opt1 from neuraminidase__InfluenzaA__ADL28014

SEQ ID NO: 80305 - RNA, 1410 nt, Artificial Sequence
  derived and/or modified sequence opt1 from neuraminidase__InfluenzaA__ADL28025
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaagaagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuaccugugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 80306 - RNA, 1410 nt, Artificial Sequence; identical to SEQ ID NO: 79492
  derived and/or modified sequence opt1 from neuraminidase__InfluenzaA__ADL28036

SEQ ID NO: 80307 - RNA, 1410 nt, Artificial Sequence; identical to SEQ ID NO: 77607
  derived and/or modified sequence opt1 from neuraminidase__InfluenzaA__ADL28047

SEQ ID NO: 80308 - RNA, 1410 nt, Artificial Sequence; identical to SEQ ID NO: 78913
  derived and/or modified sequence opt1 from neuraminidase__InfluenzaA__ADL28058

SEQ ID NO: 80309 - RNA, 1410 nt, Artificial Sequence; identical to SEQ ID NO: 80284
  derived and/or modified sequence opt1 from neuraminidase__InfluenzaA__ADL28069

SEQ ID NO: 80310 - RNA, 1410 nt, Artificial Sequence; identical to SEQ ID NO: 80131
  derived and/or modified sequence opt1 from neuraminidase__InfluenzaA__ADL28080

SEQ ID NO: 80311 - RNA, 1410 nt, Artificial Sequence; identical to SEQ ID NO: 79492
  derived and/or modified sequence opt1 from neuraminidase__InfluenzaA__ADL28091

SEQ ID NO: 80312 - RNA, 1410 nt, Artificial Sequence
  derived and/or modified sequence opt1 from neuraminidase__InfluenzaA__ADL28102
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 80313 - RNA, 1410 nt, Artificial Sequence; identical to SEQ ID NO: 77607
  derived and/or modified sequence opt1 from neuraminidase__InfluenzaA__ADL28113

SEQ ID NO: 80314 - RNA, 1410 nt, Artificial Sequence
  derived and/or modified sequence opt1 from neuraminidase__InfluenzaA__ADL28129
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggacauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagauccuguggaccuccaacagcaucgucguguucugcggcaccuccgggacguacggcaccgggagcuggccggacggcgccaacaucaaccugaugcccaucuga

SEQ ID NO: 80315 - RNA, 1410 nt, Artificial Sequence
  derived and/or modified sequence opt1 from neuraminidase__InfluenzaA__ADL28140
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccaacaucaaccugaugcccaucuga

SEQ ID NO: 80316 - RNA, 1410 nt, Artificial Sequence; identical to SEQ ID NO: 79492
  derived and/or modified sequence opt1 from neuraminidase__InfluenzaA__ADL28151

SEQ ID NO: 80317 - RNA, 1410 nt, Artificial Sequence; identical to SEQ ID NO: 78913
  derived and/or modified sequence opt1 from neuraminidase__InfluenzaA__ADL28162

SEQ ID NO: 80318 - RNA, 1410 nt, Artificial Sequence; identical to SEQ ID NO: 80131
  derived and/or modified sequence opt1 from neuraminidase__InfluenzaA__ADL28173

SEQ ID NO: 80319 - RNA, 1410 nt, Artificial Sequence; identical to SEQ ID NO: 79492
  derived and/or modified sequence opt1 from neuraminidase__InfluenzaA__ADL28184

SEQ ID NO: 80320 - RNA, 1410 nt, Artificial Sequence
  derived and/or modified sequence opt1 from neuraminidase__InfluenzaA__ADL28195
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcgugaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 80321 - RNA, 1410 nt, Artificial Sequence; identical to SEQ ID NO: 80281
  derived and/or modified sequence opt1 from neuraminidase__InfluenzaA__ADL28206

SEQ ID NO: 80322 - RNA, 1410 nt, Artificial Sequence; identical to SEQ ID NO: 78600
  derived and/or modified sequence opt1 from neuraminidase__InfluenzaA__ADL28217

SEQ ID NO: 80323 - RNA, 1410 nt, Artificial Sequence; identical to SEQ ID NO: 79492
  derived and/or modified sequence opt1 from neuraminidase__InfluenzaA__ADL28228

SEQ ID NO: 80324 - RNA, 1410 nt, Artificial Sequence; identical to SEQ ID NO: 80131
  derived and/or modified sequence opt1 from neuraminidase__InfluenzaA__ADL28239

SEQ ID NO: 80325 - RNA, 1410 nt, Artificial Sequence; identical to SEQ ID NO: 78913
  derived and/or modified sequence opt1 from neuraminidase__InfluenzaA__ADL28250

SEQ ID NO: 80326 - RNA, 1410 nt, Artificial Sequence; identical to SEQ ID NO: 80131
  derived and/or modified sequence opt1 from neuraminidase__InfluenzaA__ADL28261

SEQ ID NO: 80327 - RNA, 1410 nt, Artificial Sequence; identical to SEQ ID NO: 79492
  derived and/or modified sequence opt1 from neuraminidase__InfluenzaA__ADL28373

SEQ ID NO: 80328 - RNA, 1410 nt, Artificial Sequence; identical to SEQ ID NO: 77611
  derived and/or modified sequence opt1 from neuraminidase__InfluenzaA__ADL28387

SEQ ID NO: 80329 - RNA, 1410 nt, Artificial Sequence
  derived and/or modified sequence opt1 from neuraminidase__InfluenzaA__ADL28391
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggugcccuacguguccugcgaccccgacaagugcuaccaguucgcccucggccaggggaccacgcugaacaacguccacagcaacaacaccgugcgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucgucuccuggagcaaggagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgguaccccggcguccgcugcgugugccgggacaacuggaagggguccaaccgccccaucguggacaucaacaucaaggaccacagcaucgucuccagcuacgugugcuccggccuggugggcgacaccccgcggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagacguucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 80330 - RNA, 1410 nt, Artificial Sequence
  derived and/or modified sequence opt1 from neuraminidase__InfluenzaA__ADL28395
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggugcccuacgucuccugcgaccccgacaagugcuaccaguucgcccugggccaggggaccacccugaacaacggccacagcaacgacacggugcacgaccgcaccccguaccggacccuccugaugaacgagcugggcgugcccuuccaccucgggacccgccaggucugcaucgcgugguccagcuccagcugccacgacggcaaggccuggcugcacgugugcgugacgggggacgacgagaacgccaccgccuccuucaucuacaacggccggcuggucgacagcaucggguccuggagcaagaagauccuccgcacccaggaguccgagugcgugugcaucaacgggaccugcacgguggucaugaccgacggcagcgcguccgggaaggccgacaccaagauccuguucaucgaggagggcaagaucgugaacaucagcacccugagcggguccgcccagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcggccacggggugaagggcugggccuucgacgacggcaacgacgucuggauggggcgcaccaucagcgagaaguuccgguccggcuacgagaccuucaaggugaucgagggguggagcaagcccaacuccaagcugcagaucaaccgccaggugaucgucgagcggggcaaccgcagcggguacuccggcaucuucagcguggagggcaaguccugcaucaaccggugcuucuacguggagcucauccgcgggcggaaggaggagaccgaggucugguggacgagcaacagcaucgugguguucugcggcaccuccgggaccuacggcaccgggagcuggccggacggcgccgacaucaaccugaugcccaucuga

SEQ ID NO: 80331 - RNA, 1410 nt, Artificial Sequence; identical to SEQ ID NO: 77746
  derived and/or modified sequence opt1 from neuraminidase__InfluenzaA__ADL29675

SEQ ID NO: 80332 - RNA, 1410 nt, Artificial Sequence; identical to SEQ ID NO: 77746
  derived and/or modified sequence opt1 from neuraminidase__InfluenzaA__ADL29685

SEQ ID NO: 80333 - RNA, 1410 nt, Artificial Sequence
  derived and/or modified sequence opt1 from neuraminidase__InfluenzaA__ADL29695
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaucgucgggugguccuggcccgacggcgccgagcugccguucaccaucgacaaguga

SEQ ID NO: 80334 - RNA, 1410 nt, Artificial Sequence; identical to SEQ ID NO: 77746
  derived and/or modified sequence opt1 from neuraminidase__InfluenzaA__ADL29705

SEQ ID NO: 80335 - RNA, 1410 nt, Artificial Sequence; identical to SEQ ID NO: 80333
  derived and/or modified sequence opt1 from neuraminidase__InfluenzaA__ADL29733

SEQ ID NO: 80336 - RNA, 1410 nt, Artificial Sequence; identical to SEQ ID NO: 77746
  derived and/or modified sequence opt1 from neuraminidase__InfluenzaA__ADL29743

SEQ ID NO: 80337 - RNA, 1410 nt, Artificial Sequence
  derived and/or modified sequence opt1 from neuraminidase__InfluenzaA__ADL29753
augaaccccaaccagaagaucaucaccaucggcagcgugugcauggccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaucgucgggugguccuggcccgacggcgcggagcugccguucaccaucgacaaguga

SEQ ID NO: 80338 - RNA, 1410 nt, Artificial Sequence; identical to SEQ ID NO: 77746
  derived and/or modified sequence opt1 from neuraminidase__InfluenzaA__ADL29763

SEQ ID NO: 80339 - RNA, 1410 nt, Artificial Sequence; identical to SEQ ID NO: 80333
  derived and/or modified sequence opt1 from neuraminidase__InfluenzaA__ADL29773

SEQ ID NO: 80340 - RNA, 1410 nt, Artificial Sequence; identical to SEQ ID NO: 77746
  derived and/or modified sequence opt1 from neuraminidase__InfluenzaA__ADL29783

SEQ ID NO: 80341 - RNA, 1410 nt, Artificial Sequence; identical to SEQ ID NO: 80333
  derived and/or modified sequence opt1 from neuraminidase__InfluenzaA__ADL29882

SEQ ID NO: 80342 - RNA, 1410 nt, Artificial Sequence
  derived and/or modified sequence opt1 from neuraminidase__InfluenzaA__ADL32020
augaaccccaaccagaagaucaucaccaucggcagcgugugcaugaccaucgggauggccaaccugauccuccagaucggcaacaucaucuccacguggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80343 - RNA, 1410 nt, Artificial Sequence; identical to SEQ ID NO: 80333
  derived and/or modified sequence opt1 from neuraminidase__InfluenzaA__ADL32030

SEQ ID NO: 80344 - RNA, 1410 nt, Artificial Sequence; identical to SEQ ID NO: 77746
  derived and/or modified sequence opt1 from neuraminidase__InfluenzaA__ADL32040

SEQ ID NO: 80345 - RNA, 1410 nt, Artificial Sequence; identical to SEQ ID NO: 77746
  derived and/or modified sequence opt1 from neuraminidase__InfluenzaA__ADL32050

SEQ ID NO: 80346 - RNA, 1410 nt, Artificial Sequence; identical to SEQ ID NO: 77746
  derived and/or modified sequence opt1 from neuraminidase__InfluenzaA__ADL32060

SEQ ID NO: 80347 - RNA, 1410 nt, Artificial Sequence; identical to SEQ ID NO: 77746
  derived and/or modified sequence opt1 from neuraminidase__InfluenzaA__ADL32093

SEQ ID NO: 80348 - RNA, 1410 nt, Artificial Sequence; identical to SEQ ID NO: 77746
  derived and/or modified sequence opt1 from neuraminidase__InfluenzaA__ADL32117

SEQ ID NO: 80349 - RNA, 1410 nt, Artificial Sequence; identical to SEQ ID NO: 77746
  derived and/or modified sequence opt1 from neuraminidase__InfluenzaA__ADL32347

SEQ ID NO: 80350 - RNA, 1410 nt, Artificial Sequence
  derived and/or modified sequence opt1 from neuraminidase__InfluenzaA__ADL32357
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgguggacaaguga

SEQ ID NO: 80351 - RNA, 1410 nt, Artificial Sequence; identical to SEQ ID NO: 77746
  derived and/or modified sequence opt1 from neuraminidase__InfluenzaA__ADL32367

SEQ ID NO: 80352 - RNA, 1410 nt, Artificial Sequence; identical to SEQ ID NO: 77746
  derived and/or modified sequence opt1 from neuraminidase__InfluenzaA__ADL32377

SEQ ID NO: 80353 - RNA, 1410 nt, Artificial Sequence; identical to SEQ ID NO: 77746
  derived and/or modified sequence opt1 from neuraminidase__InfluenzaA__ADL32387

SEQ ID NO: 80354 - RNA, 1410 nt, Artificial Sequence; identical to SEQ ID NO: 77746
  derived and/or modified sequence opt1 from neuraminidase__InfluenzaA__ADL32397

SEQ ID NO: 80355 - RNA, 1410 nt, Artificial Sequence; identical to SEQ ID NO: 77746
  derived and/or modified sequence opt1 from neuraminidase__InfluenzaA__ADL32407

SEQ ID NO: 80356 - RNA, 1410 nt, Artificial Sequence; identical to SEQ ID NO: 77746
  derived and/or modified sequence opt1 from neuraminidase__InfluenzaA__ADL32417

SEQ ID NO: 80357 - RNA, 1410 nt, Artificial Sequence
  derived and/or modified sequence opt1 from neuraminidase__InfluenzaA__ADL32427
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaagaccaucuggaccagcggguccaucaucagcuucugcggcgugaacuccgacaccgucggguggagcuggcccgacggcgccgagcugccguucacgaucgacaaguga

SEQ ID NO: 80358 - RNA, 1410 nt, Artificial Sequence; identical to SEQ ID NO: 77746
  derived and/or modified sequence opt1 from neuraminidase__InfluenzaA__ADL32447

SEQ ID NO: 80359 - RNA, 1410 nt, Artificial Sequence
  derived and/or modified sequence opt1 from neuraminidase__InfluenzaA__ADL32457
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaagagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcguguccagcgacaccgucgggugguccuggcccgacggcgccgagcugccguucacgaucgacaaguga

SEQ ID NO: 80360 - RNA, 1410 nt, Artificial Sequence; identical to SEQ ID NO: 78923
  derived and/or modified sequence opt1 from neuraminidase__InfluenzaA__ADL32487

SEQ ID NO: 80361 - RNA, 1410 nt, Artificial Sequence; identical to SEQ ID NO: 77746
  derived and/or modified sequence opt1 from neuraminidase__InfluenzaA__ADL32497

SEQ ID NO: 80362 - RNA, 1410 nt, Artificial Sequence; identical to SEQ ID NO: 77746
  derived and/or modified sequence opt1 from neuraminidase__InfluenzaA__ADL32507

SEQ ID NO: 80363 - RNA, 1410 nt, Artificial Sequence; identical to SEQ ID NO: 79208
  derived and/or modified sequence opt1 from neuraminidase__InfluenzaA__ADL32517

SEQ ID NO: 80364 - RNA, 1410 nt, Artificial Sequence; identical to SEQ ID NO: 78923
  derived and/or modified sequence opt1 from neuraminidase__InfluenzaA__ADL32527

SEQ ID NO: 80365 - RNA, 1410 nt, Artificial Sequence; identical to SEQ ID NO: 77746
  derived and/or modified sequence opt1 from neuraminidase__InfluenzaA__ADL32537

SEQ ID NO: 80366 - RNA, 1410 nt, Artificial Sequence; identical to SEQ ID NO: 78633
  derived and/or modified sequence opt1 from neuraminidase__InfluenzaA__ADL32547

SEQ ID NO: 80367 - RNA, 1410 nt, Artificial Sequence; identical to SEQ ID NO: 79097
  derived and/or modified sequence opt1 from neuraminidase__InfluenzaA__ADL32673

SEQ ID NO: 80368 - RNA, 1410 nt, Artificial Sequence; identical to SEQ ID NO: 77746
  derived and/or modified sequence opt1 from neuraminidase__InfluenzaA__ADL32683

SEQ ID NO: 80369 - RNA, 1410 nt, Artificial Sequence; identical to SEQ ID NO: 77736
  derived and/or modified sequence opt1 from neuraminidase__InfluenzaA__ADL32693

SEQ ID NO: 80370 - RNA, 1410 nt, Artificial Sequence; identical to SEQ ID NO: 78969
  derived and/or modified sequence opt1 from neuraminidase__InfluenzaA__ADL32703

SEQ ID NO: 80371 - RNA, 1410 nt, Artificial Sequence; identical to SEQ ID NO: 77736
  derived and/or modified sequence opt1 from neuraminidase__InfluenzaA__ADL32713

SEQ ID NO: 80372 - RNA, 1410 nt, Artificial Sequence; identical to SEQ ID NO: 77746
  derived and/or modified sequence opt1 from neuraminidase__InfluenzaA__ADL32723

SEQ ID NO: 80373 - RNA, 1410 nt, Artificial Sequence; identical to SEQ ID NO: 79427
  derived and/or modified sequence opt1 from neuraminidase__InfluenzaA__ADL32733

SEQ ID NO: 80374 - RNA, 1410 nt, Artificial Sequence; identical to SEQ ID NO: 79427
  derived and/or modified sequence opt1 from neuraminidase__InfluenzaA__ADL32743

SEQ ID NO: 80375 - RNA, 1410 nt, Artificial Sequence
  derived and/or modified sequence opt1 from neuraminidase__InfluenzaA__ADL39139
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugagcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgagcggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 80376 - RNA, 1413 nt, Artificial Sequence
  derived and/or modified sequence opt1 from neuraminidase__InfluenzaA__ADL39150
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcagcaaccgccccuggguguccuucaaccagaaccuggacuaccagaucggguacaucugcagcggcgucuucggcgacaacccccggcccgaggacggggagggcuccugcaacccggugaccguggacggggcgaacggcgucaagggguucagcuacaaguacggcaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 80377 - RNA, 1410 nt, Artificial Sequence
  derived and/or modified sequence opt1 from neuraminidase__InfluenzaA__ADL39172
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcgaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 80378 - RNA, 1410 nt, Artificial Sequence; identical to SEQ ID NO: 77607
  derived and/or modified sequence opt1 from neuraminidase__InfluenzaA__ADL39183

SEQ ID NO: 80379 - RNA, 1413 nt, Artificial Sequence; identical to SEQ ID NO: 79938
  derived and/or modified sequence opt1 from neuraminidase__InfluenzaA__ADL39194

SEQ ID NO: 80380 - RNA, 1410 nt, Artificial Sequence; identical to SEQ ID NO: 77607
  derived and/or modified sequence opt1 from neuraminidase__InfluenzaA__ADL39205

SEQ ID NO: 80381 - RNA, 1413 nt, Artificial Sequence; identical to SEQ ID NO: 78469
  derived and/or modified sequence opt1 from neuraminidase__InfluenzaA__ADL39227

SEQ ID NO: 80382 - RNA, 1413 nt, Artificial Sequence; identical to SEQ ID NO: 79938
  derived and/or modified sequence opt1 from neuraminidase__InfluenzaA__ADL39238

SEQ ID NO: 80383 - RNA, 1413 nt, Artificial Sequence; identical to SEQ ID NO: 79938
  derived and/or modified sequence opt1 from neuraminidase__InfluenzaA__ADL39249

SEQ ID NO: 80384 - RNA, 1413 nt, Artificial Sequence; identical to SEQ ID NO: 78469
  derived and/or modified sequence opt1 from neuraminidase__InfluenzaA__ADL39260

SEQ ID NO: 80385 - RNA, 1410 nt, Artificial Sequence
  derived and/or modified sequence opt1 from neuraminidase__InfluenzaA__ADL39282
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugcccccgccuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaagguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 80386 - RNA, 1413 nt, Artificial Sequence; identical to SEQ ID NO: 78469
  derived and/or modified sequence opt1 from neuraminidase__InfluenzaA__ADL39293

SEQ ID NO: 80387 - RNA, 1410 nt, Artificial Sequence
  derived and/or modified sequence opt1 from neuraminidase__InfluenzaA__ADL39304
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 80388 - RNA, 1410 nt, Artificial Sequence; identical to SEQ ID NO: 77607
  derived and/or modified sequence opt1 from neuraminidase__InfluenzaA__ADL39326

SEQ ID NO: 80389 - RNA, 1413 nt, Artificial Sequence; identical to SEQ ID NO: 79938
  derived and/or modified sequence opt1 from neuraminidase__InfluenzaA__ADL39392

SEQ ID NO: 80390 - RNA, 1410 nt, Artificial Sequence
  derived and/or modified sequence opt1 from neuraminidase__InfluenzaA__ADL39403
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccacaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgaccugaaccucaugcccaucuga

SEQ ID NO: 80391 - RNA, 1413 nt, Artificial Sequence; identical to SEQ ID NO: 78469
  derived and/or modified sequence opt1 from neuraminidase__InfluenzaA__ADL39425

SEQ ID NO: 80392 - RNA, 1413 nt, Artificial Sequence
  derived and/or modified sequence opt1 from neuraminidase__InfluenzaA__ADL39447
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccugaccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcccccagcccguacaacuccaaguucgagagcguggcgugguccgccagcgccugccacgacggcaugggcuggcucacgaucgggaucuccggccccgacaacggggccguggcgguccugaaguacaacggcaucaucaccggcaccaucaagagcuggaagaagcagauccugcgcacccaggaguccgagugcgugugcaugaacgggagcugcuucacgaucaugaccgacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugacgguggacggcgccaacggggucaagggcuucuccuacaaguacggcaacgggguguggaucggccgcaccaagagcaaccggcugcgcaagggguucgagaugaucugggaccccaacggcuggaccaacaccgacuccgacuucagcgugaagcaggacgucguggcgaucacggacuggagcggguacuccggcagcuucgugcagcaccccgagcucaccggccuggacugcauccggcccugcuucugggucgagcuggugcgcgggcucccgcgggagaacaccaccaucuggacguccggcagcuccaucagcuucugcggggucaacuccgacaccgccaacuggagcuggcccgacggcgccgagcugcccuucaccaucgacaaguga

SEQ ID NO: 80393 - RNA, 1413 nt, Artificial Sequence; identical to SEQ ID NO: 78469
  derived and/or modified sequence opt1 from neuraminidase__InfluenzaA__ADL39458

SEQ ID NO: 80394 - RNA, 1413 nt, Artificial Sequence
  derived and/or modified sequence opt1 from neuraminidase__InfluenzaA__ADL39469
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucgacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 80395 - RNA, 1413 nt, Artificial Sequence
  derived and/or modified sequence opt1 from neuraminidase__InfluenzaA__ADL39480
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagauggugugggaccccaacggcuggacgaacaccgacuccgacuucagcgucaagcaggacgugguggccaucaccgacuggagcggguacuccggcagcuucguccagcaccccgagcucacgggccuggacugcauccggcccugcuucuggguggagcugguccgcgggcucccgcgggagaacaccaccaucuggaccuccggcagcuccaucagcuucugcggggugaacuccgacacggccaacuggagcuggcccgacggcgccgagcugcccuucaccaucgacaaguga

SEQ ID NO: 80396 - RNA, 1410 nt, Artificial Sequence
  derived and/or modified sequence opt1 from neuraminidase__InfluenzaA__ADL39491
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaucguccgcgaccggacccccuaccgcacccugcucaugaacgagcugggcgugccguuccaccugggcaccaagcaggucugcaucgccugguccagcuccagcugccacgacgggaaggccuggcuccacgugugcaucacgggcgacgacaagaacgcgaccgccuccuucaucuacaacgggcggcugguggacagcaucguguccuggagcaaggagauccugcgcacccaggaguccgagugcgucugcaucaacgggaccugcacgguggugaugaccgacgggagcgccagcggcaaggccgacaccaagauccucuucaucgaggagggcaagaucguccacaccuccacgcugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcggccacggggugaagggcugggccuucgacgacgggaacgacgucuggaugggccgcaccaucuccgagaagucccggcugggcuacgagaccuucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagacggaggugcuguggaccagcuccagcaucguggucuucugcggcaccuccgggaccuacggcacggggagcuggcccgacggcgccgacaucaaccugaugccgaucuga

SEQ ID NO: 80397 - RNA, 1410 nt, Artificial Sequence; identical to SEQ ID NO: 77746
  derived and/or modified sequence opt1 from neuraminidase__InfluenzaA__ADL41165

SEQ ID NO: 80398 - RNA, 1410 nt, Artificial Sequence
  derived and/or modified sequence opt1 from neuraminidase__InfluenzaA__ADL41175
augaaccccaaccagaagaucaucaccaucggcagcgugugcaugaccaucgggauggccaaccugauccuccagaucggcaacaucaucuccacguggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 80399 - RNA, 1413 nt, Artificial Sequence
  derived and/or modified sequence opt1 from neuraminidase__InfluenzaA__ADL60255
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaacuacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccaaggacggccgcggguccugcaacccggugaccguggacggcgcgaacggggucaagggcuucagcuacaaguacgacaacggcguguggaucgggcggacgaaguccaaccgccugcggaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccgccccugcuucugggucgagcuggugcggggccucccgcgcgagaacaccaccaucuggaccagcggguccagcaucuccuucugcggcgucaacagcgacacggccaacugguccuggcccgacggggccgagcugcccuucaccaucgacaaguga

SEQ ID NO: 80400 - RNA, 1413 nt, Artificial Sequence
  derived and/or modified sequence opt1 from neuraminidase__InfluenzaA__ADL60277
augaaccccaaccagcgcaucaucaccaucggcagcaucuccaucgccaucgggaucaucagccugaugcuccagaucggcaacaucaucuccaucugggccagccacuccauccagaucgggagccagaacaacaccggcaucugcaaccagcggaucaucacguacgagaacuccaccugggugaaccacaccuacgucaacaucaacaacaccaacgugguggcgggggaggacaagacgccggucacccuggccggcaacagcucccugugcagcaucuccggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccgccaaggaccggucccccuaccgcgcgcugaugagcugcccccugggggaggccccgucccccuacaacagcaaguucgagagcgucgccugguccgccagcgcgugccacgacggcaugggcuggcucaccaucgggaucuccggccccgacaacggggccguggccgugcugaaguacaacggcaucaucaccggcacgaucaagagcuggaagaagcagauccugcggacccaggaguccgagugcgucugcaugaacgggagcugcuucaccaucaugaccgacggccccuccaacaaggccgccagcuacaagaucuucaagaucgagaaggggaaggugacgaaguccaucgagcucaacgcgccgaacuucuacuacgaggagugcagcugcuaccccgacaccggcaucgugaugugcgucugccgcgacaacuggcacggguccaaccggcccugggugagcuucaaccagaaccuggacuaccagaucggcuacaucugcuccggcguguucggggacaacccccgcccggaggacggcgaggggagcugcaaccccgucaccguggacggcgccaacggggugaagggcuucuccuacaaguacggcaacggggucuggaucggccggaccaagagcaaccgccugcggaagggguucgagaugaucugggaccccaacggcuggacgaacaccgacuccgacuucagcgugaagcaggacguggucgccaucaccgacugguccggguacagcggcagcuucgugcagcaccccgagcucaccggccuggacugcauccgcccgugcuucuggguggagcugguccgggggcucccccgcgagaacacgaccaucuggaccuccggcagcuccaucagcuucugcggggugaacuccgacaccgccaacuggagcuggcccgacggcgccgagcugcccuucacgaucgacaaguga

SEQ ID NO: 80401 - RNA, 1413 nt, Artificial Sequence
  derived and/or modified sequence opt1 from neuraminidase__InfluenzaA__ADL60288
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccaaggacggcaagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 80402 - RNA, 1413 nt, Artificial Sequence
  derived and/or modified sequence opt1 from neuraminidase__InfluenzaA__ADL60299
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccaggaccuggacuaccagaucggcuacaucugcuccggcgucuucggggacaacccccggcccaaggacggcaaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 80403 - RNA, 1413 nt, Artificial Sequence; identical to SEQ ID NO: 77640
  derived and/or modified sequence opt1 from neuraminidase__InfluenzaA__ADL60310

SEQ ID NO: 80404 - RNA, 1413 nt, Artificial Sequence
  derived and/or modified sequence opt1 from neuraminidase__InfluenzaA__ADL60321
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcauggucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 80405 - RNA, 1413 nt, Artificial Sequence
  derived and/or modified sequence opt1 from neuraminidase__InfluenzaA__ADL60332
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccaaggacggccgcggguccugcaacccggugaccguggacggcgcgaacggggucaagggcuucagcuacaaguacgacaacggcguguggaucgggcggacgaaguccaaccgccugcggaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccgccccugcuucugggucgagcuggugcggggccucccgcgcgagaacaccaccaucuggaccagcggguccagcaucuccuucugcggcgucaacagcgacacggccaacugguccuggcccgacggggccgagcugcccuucaccaucgacaaguga

SEQ ID NO: 80406 - RNA, 1413 nt, Artificial Sequence; identical to SEQ ID NO: 77640
  derived and/or modified sequence opt1 from neuraminidase__InfluenzaA__ADL60343

SEQ ID NO: 80407 - RNA, 1413 nt, Artificial Sequence
  derived and/or modified sequence opt1 from neuraminidase__InfluenzaA__ADL60354
augaaccccaaccagcgcaucaucaccaucggcagcaucuccaucgccaucgggaucaucagccugaugcuccagaucggcaacaucaucuccaucugggccagccacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacgcagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagagcgagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggagcaaccggcccuggguguccuucaaccagaaccuggacuaccagaucggcuacaucugcagcggcguguucggggacaacccccgccccaaggacggcaagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacagcgacuucuccgugaagcaggacguggucgccaucaccgacuggagcggguacagcggcuccuucgugcagcaccccgagcucaccggccuggacugcauccgccccugcuucuggguggagcugguccgggggcucccgcgcgagaacacgaccaucuggaccagcggcuccagcaucuccuucugcggggugaacagcgacaccgccaacugguccuggcccgacggcgccgagcugcccuucacgaucgacaaguga

SEQ ID NO: 80408 - RNA, 1410 nt, Artificial Sequence
  derived and/or modified sequence opt1 from neuraminidase__InfluenzaA__ADL60365
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucucccccaagcuggccgaguaccggaacuggagcaagccccagugcgacaucaccggguucgcgccguucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaucguccgcgaccggacccccuaccgcacccugcucaugaacgagcugggcgugccguuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccaucgugagcugguccaaggagauccugcgcacccaggagagcgagugcgucugcaucaacgggaccugcacgguggugaugaccgacgggagcgccuccggcaaggccgacaccaagauccucuucaucgaggagggcaagaucguccacaccagcacgcuguccgggagcgcgcagcacguggaggagugcuccugcuacccccgguaccccggcgugcgcugcgucugccgggacaacuggaaggggagcaaccgccccaucguggacaucaacaucaaggaccacuccaccgugagcuccuacgucugcagcggccuggugggcgacaccccgcggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagacguucaaggugaucgagggguggagcaaccccaaguccaagcugcagaucaaccgccaggucaucguggaccggggcaaccgcagcggguacagcggcaucuucuccguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgacaucaaccugaugccgaucuga

SEQ ID NO: 80409 - RNA, 1413 nt, Artificial Sequence
  derived and/or modified sequence opt1 from neuraminidase__InfluenzaA__ADL60376
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgggaaggaccgcagccccuaccgggcccugauguccugcccccugggcgaggcgcccagcccguacaacagcaaguucgaguccgucgccuggagcgccuccgccugccacgacggcaugggguggcucaccaucggcaucagcgggcccgacaacggcgcgguggccgugcugaaguacaacggcaucaucacggggaccaucaaguccuggaagaagcagauccugcgcacccaggagagcgagugcgucugcaugaacggcuccugcuucaccaucaugacggacgggcccagcaacaaggccgccuccuacaagaucuucaagaucgagaagggcaaggugaccaagagcaucgagcucaacgcccccaacuuccacuacgaggagugcuccugcuacccggacaccgggaucgugaugugcgucugccgggacaacuggcacggcagcaaccgccccuggguguccuucaaccagaaccuggacuaccagaucggcuacaucugcagcgggguguucggcgacaacccccggcccaaggacgggaagggcuccugcaacccggucaccguggacggggcgaacggcgugaagggcuucagcuacaaguacgacaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 80410 - RNA, 1410 nt, Artificial Sequence; identical to SEQ ID NO: 77746
  derived and/or modified sequence opt1 from neuraminidase__InfluenzaA__ADM07137

SEQ ID NO: 80411 - RNA, 1410 nt, Artificial Sequence; identical to SEQ ID NO: 77746
  derived and/or modified sequence opt1 from neuraminidase__InfluenzaA__ADM07146

SEQ ID NO: 80412 - RNA, 1410 nt, Artificial Sequence; identical to SEQ ID NO: 77746
  derived and/or modified sequence opt1 from neuraminidase__InfluenzaA__ADM07156

SEQ ID NO: 80413 - RNA, 1410 nt, Artificial Sequence; identical to SEQ ID NO: 77746
  derived and/or modified sequence opt1 from neuraminidase__InfluenzaA__ADM07165

SEQ ID NO: 80414 - RNA, 1413 nt, Artificial Sequence; identical to SEQ ID NO: 78469
  derived and/or modified sequence opt1 from neuraminidase__InfluenzaA__ADM07474

SEQ ID NO: 80415 - RNA, 1413 nt, Artificial Sequence; identical to SEQ ID NO: 78469
  derived and/or modified sequence opt1 from neuraminidase__InfluenzaA__ADM07485

SEQ ID NO: 80416 - RNA, 1410 nt, Artificial Sequence
  derived and/or modified sequence opt1 from neuraminidase__InfluenzaA__ADM07496
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaacaucaugcccaucuga

SEQ ID NO: 80417 - RNA, 1410 nt, Artificial Sequence
  derived and/or modified sequence opt1 from neuraminidase__InfluenzaA__ADM07507
augaaccccaaccagaagaucaucaccaucggcagcgugucccugaccaucagcacgaucugcuucuucaugcagaccgccauccucaucaccaccgucacgcugcacuucaagcaguucgaguucaacuccccgcccaacaaccaggugaugcugugcgagcccgccaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggcggacaccaagauccucuucaucgaggagggcaagaucgugcacacgagcacccuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 80418 - RNA, 1410 nt, Artificial Sequence
  derived and/or modified sequence opt1 from neuraminidase__InfluenzaA__ADM12820
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 80419 - RNA, 1410 nt, Artificial Sequence; identical to SEQ ID NO: 80418
  derived and/or modified sequence opt1 from neuraminidase__InfluenzaA__ADM12831

SEQ ID NO: 80420 - RNA, 1410 nt, Artificial Sequence; identical to SEQ ID NO: 80418
  derived and/or modified sequence opt1 from neuraminidase__InfluenzaA__ADM12842

SEQ ID NO: 80421 - RNA, 1410 nt, Artificial Sequence; identical to SEQ ID NO: 80418
  derived and/or modified sequence opt1 from neuraminidase__InfluenzaA__ADM12853

SEQ ID NO: 80422 - RNA, 1410 nt, Artificial Sequence; identical to SEQ ID NO: 77746
  derived and/or modified sequence opt1 from neuraminidase__InfluenzaA__ADM12864

SEQ ID NO: 80423 - RNA, 1410 nt, Artificial Sequence; identical to SEQ ID NO: 77746
  derived and/or modified sequence opt1 from neuraminidase__InfluenzaA__ADM12874

SEQ ID NO: 80424 - RNA, 1410 nt, Artificial Sequence; identical to SEQ ID NO: 77746
  derived and/or modified sequence opt1 from neuraminidase__InfluenzaA__ADM12884

SEQ ID NO: 80425 - RNA, 1410 nt, Artificial Sequence
  derived and/or modified sequence opt1 from neuraminidase__InfluenzaA__ADM12894
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccagagcuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80426 - RNA, 1410 nt, Artificial Sequence; identical to SEQ ID NO: 77746
  derived and/or modified sequence opt1 from neuraminidase__InfluenzaA__ADM12904

SEQ ID NO: 80427 - RNA, 1410 nt, Artificial Sequence
  derived and/or modified sequence opt1 from neuraminidase__InfluenzaA__ADM12914
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcuacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80428 - RNA, 1410 nt, Artificial Sequence; identical to SEQ ID NO: 77746
  derived and/or modified sequence opt1 from neuraminidase__InfluenzaA__ADM12924

SEQ ID NO: 80429 - RNA, 1410 nt, Artificial Sequence; identical to SEQ ID NO: 77746
  derived and/or modified sequence opt1 from neuraminidase__InfluenzaA__ADM12934

SEQ ID NO: 80430 - RNA, 1410 nt, Artificial Sequence; identical to SEQ ID NO: 77746
  derived and/or modified sequence opt1 from neuraminidase__InfluenzaA__ADM12944

SEQ ID NO: 80431 - RNA, 1410 nt, Artificial Sequence; identical to SEQ ID NO: 77746
  derived and/or modified sequence opt1 from neuraminidase__InfluenzaA__ADM12954

SEQ ID NO: 80432 - RNA, 1410 nt, Artificial Sequence; identical to SEQ ID NO: 77746
  derived and/or modified sequence opt1 from neuraminidase__InfluenzaA__ADM12964

SEQ ID NO: 80433 - RNA, 1410 nt, Artificial Sequence; identical to SEQ ID NO: 79034
  derived and/or modified sequence opt1 from neuraminidase__InfluenzaA__ADM12974

SEQ ID NO: 80434 - RNA, 1410 nt, Artificial Sequence
  derived and/or modified sequence opt1 from neuraminidase__InfluenzaA__ADM12984
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccauccgcagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 80435 - RNA, 1410 nt, Artificial Sequence; identical to SEQ ID NO: 77746
  derived and/or modified sequence opt1 from neuraminidase__InfluenzaA__ADM12994

SEQ ID NO: 80436 - RNA, 1410 nt, Artificial Sequence; identical to SEQ ID NO: 77746
  derived and/or modified sequence opt1 from neuraminidase__InfluenzaA__ADM13004

SEQ ID NO: 80437 - RNA, 1410 nt, Artificial Sequence; identical to SEQ ID NO: 77746
  derived and/or modified sequence opt1 from neuraminidase__InfluenzaA__ADM13014

SEQ ID NO: 80438 - RNA, 1410 nt, Artificial Sequence
  derived and/or modified sequence opt1 from neuraminidase__InfluenzaA__ADM13034
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcaacugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80439 - RNA, 1410 nt, Artificial Sequence; identical to SEQ ID NO: 79659
  derived and/or modified sequence opt1 from neuraminidase__InfluenzaA__ADM13044

SEQ ID NO: 80440 - RNA, 1410 nt, Artificial Sequence; identical to SEQ ID NO: 78572
  derived and/or modified sequence opt1 from neuraminidase__InfluenzaA__ADM13054

SEQ ID NO: 80441 - RNA, 1410 nt, Artificial Sequence; identical to SEQ ID NO: 78923
  derived and/or modified sequence opt1 from neuraminidase__InfluenzaA__ADM13064

SEQ ID NO: 80442 - RNA, 1410 nt, Artificial Sequence
  derived and/or modified sequence opt1 from neuraminidase__InfluenzaA__ADM13074
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80443 - RNA, 1410 nt, Artificial Sequence; identical to SEQ ID NO: 78923
  derived and/or modified sequence opt1 from neuraminidase__InfluenzaA__ADM13084

SEQ ID NO: 80444 - RNA, 1410 nt, Artificial Sequence
  derived and/or modified sequence opt1 from neuraminidase__InfluenzaA__ADM13094
augaaccccaaccagaagaucaucaccaucggcagcgugugcaugaccaucgggauggccaaccugauccuccagaucggcaacacgaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgccaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgcggagcugccguucaccaucgacaaguga

SEQ ID NO: 80445 - RNA, 1410 nt, Artificial Sequence; identical to SEQ ID NO: 78923
  derived and/or modified sequence opt1 from neuraminidase__InfluenzaA__ADM13104

SEQ ID NO: 80446 - RNA, 1410 nt, Artificial Sequence; identical to SEQ ID NO: 79648
  derived and/or modified sequence opt1 from neuraminidase__InfluenzaA__ADM13124

SEQ ID NO: 80447 - RNA, 1410 nt, Artificial Sequence
  derived and/or modified sequence opt1 from neuraminidase__InfluenzaA__ADM13134
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacacgcugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80448 - RNA, 1410 nt, Artificial Sequence
  derived and/or modified sequence opt1 from neuraminidase__InfluenzaA__ADM13154
augaaccccaaccagaagaucaucaccaucggcagcgugugcaugaccaucgggauggccaaccugauccuccagaucggcaacaucaucuccaucuggaucagccacuccauccagcuggggaaccagaagcagaucgagacgugcaaccagagcgucuucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 80449 - RNA, 1410 nt, Artificial Sequence; identical to SEQ ID NO: 79176
  derived and/or modified sequence opt1 from neuraminidase__InfluenzaA__ADM13164

SEQ ID NO: 80450 - RNA, 1410 nt, Artificial Sequence; identical to SEQ ID NO: 77746
  derived and/or modified sequence opt1 from neuraminidase__InfluenzaA__ADM13174

SEQ ID NO: 80451 - RNA, 1410 nt, Artificial Sequence; identical to SEQ ID NO: 77746
  derived and/or modified sequence opt1 from neuraminidase__InfluenzaA__ADM13184

SEQ ID NO: 80452 - RNA, 1410 nt, Artificial Sequence; identical to SEQ ID NO: 77746
  derived and/or modified sequence opt1 from neuraminidase__InfluenzaA__ADM13194

SEQ ID NO: 80453 - RNA, 1410 nt, Artificial Sequence; identical to SEQ ID NO: 77746
  derived and/or modified sequence opt1 from neuraminidase__InfluenzaA__ADM13204

SEQ ID NO: 80454 - RNA, 1410 nt, Artificial Sequence; identical to SEQ ID NO: 78923
  derived and/or modified sequence opt1 from neuraminidase__InfluenzaA__ADM13214

SEQ ID NO: 80455 - RNA, 1410 nt, Artificial Sequence
  derived and/or modified sequence opt1 from neuraminidase__InfluenzaA__ADM13224
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccauccgcagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcaagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 80456 - RNA, 1410 nt, Artificial Sequence; identical to SEQ ID NO: 77746
  derived and/or modified sequence opt1 from neuraminidase__InfluenzaA__ADM13234

SEQ ID NO: 80457 - RNA, 1410 nt, Artificial Sequence; identical to SEQ ID NO: 79034
  derived and/or modified sequence opt1 from neuraminidase__InfluenzaA__ADM13244

SEQ ID NO: 80458 - RNA, 1410 nt, Artificial Sequence; identical to SEQ ID NO: 78100
  derived and/or modified sequence opt1 from neuraminidase__InfluenzaA__ADM13254

SEQ ID NO: 80459 - RNA, 1410 nt, Artificial Sequence; identical to SEQ ID NO: 78923
  derived and/or modified sequence opt1 from neuraminidase__InfluenzaA__ADM13264

SEQ ID NO: 80460 - RNA, 1410 nt, Artificial Sequence; identical to SEQ ID NO: 77746
  derived and/or modified sequence opt1 from neuraminidase__InfluenzaA__ADM13274

SEQ ID NO: 80461 - RNA, 1410 nt, Artificial Sequence; identical to SEQ ID NO: 77746
  derived and/or modified sequence opt1 from neuraminidase__InfluenzaA__ADM13284

SEQ ID NO: 80462 - RNA, 1410 nt, Artificial Sequence
  derived and/or modified sequence opt1 from neuraminidase__InfluenzaA__ADM13294
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcgcccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacagcuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgcggagcugccguucaccaucgacaaguga

SEQ ID NO: 80463 - RNA, 1410 nt, Artificial Sequence; identical to SEQ ID NO: 77746
  derived and/or modified sequence opt1 from neuraminidase__InfluenzaA__ADM13304

SEQ ID NO: 80464 - RNA, 1410 nt, Artificial Sequence; identical to SEQ ID NO: 79208
  derived and/or modified sequence opt1 from neuraminidase__InfluenzaA__ADM13314

SEQ ID NO: 80465 - RNA, 1410 nt, Artificial Sequence; identical to SEQ ID NO: 77746
  derived and/or modified sequence opt1 from neuraminidase__InfluenzaA__ADM13324

SEQ ID NO: 80466 - RNA, 1410 nt, Artificial Sequence
  derived and/or modified sequence opt1 from neuraminidase__InfluenzaA__ADM13344
augaaccccaaccagaagaucaucaucaucggcagcgugugcaugaccaucgggauggccaaccugauccuccagaucggcaacaucaucuccaucuggauccugcacagcauccagcuggggaaccagaaccagaucgagaccugcaaccaguccgucaucacguacgagaacaacaccugggugaaccagaccuacgugaacaucagcaacaccaacuucgccgcgggccaguccgucgugagcgugaagcucgccgggaacuccagccugugcccggucuccggcugggccaucuacagcaaggacaacuccauccgcaucggcagcaagggggacguguucgugauccgggagcccuucaucuccugcagcccccuggagugccgcacguucuuccucacccagggcgcccugcugaacgacaagcacuccaacgggaccaucaaggaccggagccccuaccgcacccucauguccugcccgaucggcgagguccccagccccuacaacucccgguucgagagcguggccuggagcgcguccgccugccacgacgggaucaacuggcugacgaucggcaucagcggccccgacaacggggccguggccguccugaaguacaacggcaucaucaccgacaccaucaaguccuggcgcaacaacauccuccggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucgccaucaagcaggacaucguggggaucaacgagugguccggcuacagcggguccuucgugcagcacccggagcugaccggccucgacugcauccgccccugcuucugggucgagcugauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 80467 - RNA, 1410 nt, Artificial Sequence; identical to SEQ ID NO: 79648
  derived and/or modified sequence opt1 from neuraminidase__InfluenzaA__ADM13354

SEQ ID NO: 80468 - RNA, 1410 nt, Artificial Sequence; identical to SEQ ID NO: 78923
  derived and/or modified sequence opt1 from neuraminidase__InfluenzaA__ADM13363

SEQ ID NO: 80469 - RNA, 1410 nt, Artificial Sequence
  derived and/or modified sequence opt1 from neuraminidase__InfluenzaA__ADM13464
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccgggaacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcgagcaggagacccgggugugguggaccuccaacagcaucguggucuucugcgggaccuccggcacguacgggaccggcagcuggccggacggggccaacaucaacuucaugcccaucuga

SEQ ID NO: 80470 - RNA, 1410 nt, Artificial Sequence
  derived and/or modified sequence opt1 from neuraminidase__InfluenzaA__ADM13465
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucaugcggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 80471 - RNA, 1410 nt, Artificial Sequence; identical to SEQ ID NO: 75103
  derived and/or modified sequence opt1 from neuraminidase__InfluenzaA__ADM13466

SEQ ID NO: 80472 - RNA, 1410 nt, Artificial Sequence
  derived and/or modified sequence opt1 from neuraminidase__InfluenzaA__ADM13467
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccagcggcggggacaucugggugacgcgggagcccuacguguccugcgaccacggcaagugcuaccaguucgcccuggggcagggcaccacccucgacaacaagcacagcaacgacaccauccacgaccgcaucccccaccggacgcugcugaugaacgagcucggcgucccguuccaccuggggacccgccaggugugcaucgccugguccagcuccagcugccacgacggcaaggccuggcugcacgugugcaucaccggggacgacaagaacgcgaccgccuccuucaucuacgacggccggcucgucgacagcaucggguccuggagccagaacauccugcgcacgcaggaguccgagugcgugugcaucaacgggaccugcaccguggucaugaccgacggcagcgccagcggccgggccgacacgcgcauccuguucaucgaggagggcaagaucgugcacaucagcccccucuccggguccgcgcagcacguggaggagugcagcugcuacccccgguaccccggcguccgcugcaucugccgggacaacuggaagggcuccaaccgcccggugguggacaucaacauggaggacuacagcaucgacuccagcuacgucugcuccgggcuggugggcgacacgccccggaacgacgaccgcagcuccaacagcaacugccggaaccccaacaacgagcgcgggaaccagggcgugaaggggugggccuucgacaacggcgacgacgucuggaugggccggaccaucuccaaggaccugcgcagcggguacgagaccuucaaggugaucggcgggugguccacccccaacagcaagucccagaucaaccggcaggucaucguggacagcgacaaccgcuccggcuacagcgggaucuucagcguggagggcaaguccugcaucaaccgcugcuucuacgucgagcucauccggggccgcaagcaggagacccgggugugguggaccagcaacuccaucguggucuucugcgggaccagcggcacguacgggaccggcuccuggccggacggggccaacaucaacuucaugcccaucuga

SEQ ID NO: 80473 - RNA, 1410 nt, Artificial Sequence; identical to SEQ ID NO: 75103
  derived and/or modified sequence opt1 from neuraminidase__InfluenzaA__ADM13468

SEQ ID NO: 80474 - RNA, 1410 nt, Artificial Sequence
  derived and/or modified sequence opt1 from neuraminidase__InfluenzaA__ADM13469
augaaccccaaccagaagaucaucaccaucggcagcgugucccugaccaucgccacggccugcuuccucaugcagaucgcgauccuggucaccaccgugacccugcacuucaagcaguacgagugcgacagcccggccuccaaccaggugaugcccugcgagcccaucaucaucgagcgcaacaucacggagaucgucuaccucaacaacaccaccaucgagaaggagaucugccccaaggugguggaguaccggaacuggagcaagccgcagugccagaucaccggguucgcccccuucuccaaggacaacagcauccgccuguccgccggcggggacaucugggucacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgugccguuccaccuggggacccgccaggucugcaucgcguggagcuccagcuccugccacgacggcaaggccuggcugcacgugugcaucaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgcgagcggccgggccgacacgcgcauccuguucaucgaggagggcaagaucguccacaucagcccccucuccgggagcgcccagcacguggaggagugcuccugcuacccccgguaccccggcgugcgcugcaucugccgggacaacuggaagggcagcaaccgcccggucguggacaucaacauggaggacuacuccaucgacagcuccuacgugugcagcgggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggagcacccccaacuccaagagccagaucaaccgccaggugaucgucgacuccgacaaccggagcggcuacuccgggaucuucagcguggagggcaagagcugcaucaaccgcugcuucuacguggagcucauccggggccgcaagcaggagacccgggucugguggaccuccaacagcaucgugguguucugcgggaccuccggcacguacgggaccggcagcuggccggacggggccaacaucaacuucaugcccaucuga

SEQ ID NO: 80475 - RNA, 1410 nt, Artificial Sequence
  derived and/or modified sequence opt1 from neuraminidase__InfluenzaA__ADM13470
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucaucgacuccgacaaccgcagcggcuacuccgggaucuucagcguggagggcaagagcugcaucaaccgcugcuucuacguggagcucauccggggccgcaagcaggagacccgggucugguggaccuccaacagcaucgugguguucugcgggaccuccggcacguacgggaccggcagcuggccggacggggccaacaucaacuucaugcccaucuga

SEQ ID NO: 80476 - RNA, 1410 nt, Artificial Sequence
  derived and/or modified sequence opt1 from neuraminidase__InfluenzaA__ADM13471
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgcaucuccgccggcggggacaucugggugacgcgggagcccuacgugagcugcgaccacggcaagugcuaccaguucgcccuggggcagggcaccacccuggacaacaagcacuccaacgacaccauccacgaccgcaucccccaccggacgcuccugaugaacgagcugggcgucccguuccaccucgggacccgccaggugugcaucgccuggagcuccagcuccugccacgacggcaaggcguggcugcacgugugcaucaccggggacgacaagaacgccaccgccagcuucaucuacgacggccggcuggucgacuccaucgggagcuggucccagaacauccuccgcacgcaggagagcgagugcgugugcaucaacgggaccugcaccguggucaugaccgacggcuccgccagcggccgggcggacacgcgcauccuguucaucgaggagggcaagaucgugcacaucagcccccuguccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcucgugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcugauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 80477 - RNA, 1410 nt, Artificial Sequence; identical to SEQ ID NO: 77516
  derived and/or modified sequence opt1 from neuraminidase__InfluenzaA__ADM13472

SEQ ID NO: 80478 - RNA, 1410 nt, Artificial Sequence; identical to SEQ ID NO: 75103
  derived and/or modified sequence opt1 from neuraminidase__InfluenzaA__ADM13473

SEQ ID NO: 80479 - RNA, 1410 nt, Artificial Sequence; identical to SEQ ID NO: 77511
  derived and/or modified sequence opt1 from neuraminidase__InfluenzaA__ADM13474

SEQ ID NO: 80480 - RNA, 1410 nt, Artificial Sequence
  derived and/or modified sequence opt1 from neuraminidase__InfluenzaA__ADM14469
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcaugcgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaccggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80481 - RNA, 1410 nt, Artificial Sequence; identical to SEQ ID NO: 77746
  derived and/or modified sequence opt1 from neuraminidase__InfluenzaA__ADM14479

SEQ ID NO: 80482 - RNA, 1410 nt, Artificial Sequence; identical to SEQ ID NO: 77746
  derived and/or modified sequence opt1 from neuraminidase__InfluenzaA__ADM14499

SEQ ID NO: 80483 - RNA, 1410 nt, Artificial Sequence; identical to SEQ ID NO: 79259
  derived and/or modified sequence opt1 from neuraminidase__InfluenzaA__ADM14518

SEQ ID NO: 80484 - RNA, 1410 nt, Artificial Sequence; identical to SEQ ID NO: 80084
  derived and/or modified sequence opt1 from neuraminidase__InfluenzaA__ADM14527

SEQ ID NO: 80485 - RNA, 1410 nt, Artificial Sequence; identical to SEQ ID NO: 79177
  derived and/or modified sequence opt1 from neuraminidase__InfluenzaA__ADM14537

SEQ ID NO: 80486 - RNA, 1410 nt, Artificial Sequence; identical to SEQ ID NO: 77746
  derived and/or modified sequence opt1 from neuraminidase__InfluenzaA__ADM14546

SEQ ID NO: 80487 - RNA, 1410 nt, Artificial Sequence
  derived and/or modified sequence opt1 from neuraminidase__InfluenzaA__ADM14555
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuuccgcuacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 80488 - RNA, 1410 nt, Artificial Sequence; identical to SEQ ID NO: 77746
  derived and/or modified sequence opt1 from neuraminidase__InfluenzaA__ADM14573

SEQ ID NO: 80489 - RNA, 1410 nt, Artificial Sequence; identical to SEQ ID NO: 77746
  derived and/or modified sequence opt1 from neuraminidase__InfluenzaA__ADM14582

SEQ ID NO: 80490 - RNA, 1410 nt, Artificial Sequence; identical to SEQ ID NO: 77746
  derived and/or modified sequence opt1 from neuraminidase__InfluenzaA__ADM14591

SEQ ID NO: 80491 - RNA, 1410 nt, Artificial Sequence
  derived and/or modified sequence opt1 from neuraminidase__InfluenzaA__ADM14601
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucccgguucgagagcguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 80492 - RNA, 1410 nt, Artificial Sequence
  derived and/or modified sequence opt1 from neuraminidase__InfluenzaA__ADM14611
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugagcgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgccugcgugaacggguccugcuucaccgugaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80493 - RNA, 1410 nt, Artificial Sequence; identical to SEQ ID NO: 77746
  derived and/or modified sequence opt1 from neuraminidase__InfluenzaA__ADM14620

SEQ ID NO: 80494 - RNA, 1410 nt, Artificial Sequence; identical to SEQ ID NO: 77746
  derived and/or modified sequence opt1 from neuraminidase__InfluenzaA__ADM14629

SEQ ID NO: 80495 - RNA, 1410 nt, Artificial Sequence; identical to SEQ ID NO: 77746
  derived and/or modified sequence opt1 from neuraminidase__InfluenzaA__ADM14639

SEQ ID NO: 80496 - RNA, 1410 nt, Artificial Sequence; identical to SEQ ID NO: 77746
  derived and/or modified sequence opt1 from neuraminidase__InfluenzaA__ADM14657

SEQ ID NO: 80497 - RNA, 1410 nt, Artificial Sequence; identical to SEQ ID NO: 77746
  derived and/or modified sequence opt1 from neuraminidase__InfluenzaA__ADM14666

SEQ ID NO: 80498 - RNA, 1410 nt, Artificial Sequence; identical to SEQ ID NO: 77746
  derived and/or modified sequence opt1 from neuraminidase__InfluenzaA__ADM14684

SEQ ID NO: 80499 - RNA, 1410 nt, Artificial Sequence
  derived and/or modified sequence opt1 from neuraminidase__InfluenzaA__ADM14693
augaaccccaaccagaagaugaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80500 - RNA, 1410 nt, Artificial Sequence
  derived and/or modified sequence opt1 from neuraminidase__InfluenzaA__ADM14702
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcucccaccuggagugccgcaccuucuuccugacccagggcgcccuccugaacgacaagcacagcaacgggaccaucaaggaccggucccccuaccgcacgcugaugagcugccccaucggcgaggucccgucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccccggccgaacgacaagaccggcagcugcggccccguguccagcaacggggccaacggcgugaagggguucuccuucaaguacggcaacggggccuggaucggccgcaccaagagcaccagcucccggaacggcuucgagaugaucugggaccccaacggguggaccggcacggacaacaacuucagcaucaagcaggacaucgucgggaucaacgagugguccggcuacagcggguccuucgugcagcaccccgagcugaccggccuggacugcauccgcccgugcuucuggguggagcucauccggggccgccccaaggagaacaccaucuggaccagcggguccagcaucuccuucugcggcgucaacagcgacacgguggggugguccuggcccgacggcgcggagcugcccuucaccaucgacaaguga

SEQ ID NO: 80501 - RNA, 1410 nt, Artificial Sequence; identical to SEQ ID NO: 79648
  derived and/or modified sequence opt1 from neuraminidase__InfluenzaA__ADM14711

SEQ ID NO: 80502 - RNA, 1410 nt, Artificial Sequence
  derived and/or modified sequence opt1 from neuraminidase__InfluenzaA__ADM14720
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcguguucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80503 - RNA, 1410 nt, Artificial Sequence
  derived and/or modified sequence opt1 from neuraminidase__InfluenzaA__ADM14730
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccgucuacuccaaggacaacagcauccgcaucggcuccaagggggacgugcuggugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80504 - RNA, 1350 nt, Artificial Sequence
  derived and/or modified sequence opt1 from neuraminidase__InfluenzaA__ADM14748
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucugccggaccuucuuccugacccagggcgcccugcucaacgacaagcacuccaacgggaccaucaaggaccgcagccccuaccggacgcugauguccugccccaucggcgaggugcccagcccguacaacucccgcuucgagagcguggccugguccgcgagcgccugccacgacgggaucaacuggcugaccaucggcaucagcgggcccgacaacggcgccgucgccgugcucaaguacaacggcaucaucaccgacaccaucaaguccuggcggaacaacauccugcgcacgcaggagagcgagugcgcgugcgugaacggguccugcuucaccgucaugaccgacggccccagcgacgggcaggccuccuacaagaucuuccggaucgagaagggcaagaucgucaagagcguggagaugaacgcccccaacuaccacuacgaggagugcuccugcuacccggacagcuccgagaucacgugcgugugccgcgacaacuggcacggcagcaaccggcccuggguguccuucaaccagaaccuggaguaccagaucggguacaucugcagcggcaucuucggggacaacccccgccccaacgacaagaccggcuccugcgggccggugagcuccaacggcgccaacggcgucaagggguucagcuucaaguacggcaacgggguguggaucggccggaccaaguccaucagcucccgcaacggguucgagaugaucugggaccccaacggcuggaccggcaccgacaacaacuucagcaucaagcaggacaucguggggaucaacgaguggagcggcuacuccgggagcuucguccagcaccccgagcucacgggccuggacugcauccggcccugcuucuggguggagcugauccgcgggcggccgaaggagaacaccaucuggaccuccggcagcuccaucagcuucugcggcgugaacuccgacaccgucggguggagcuggcccgacggcgccgagcuccccuucacgaucgacaaguga

SEQ ID NO: 80505 - RNA, 1410 nt, Artificial Sequence
  derived and/or modified sequence opt1 from neuraminidase__InfluenzaA__ADM14758
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80506 - RNA, 1410 nt, Artificial Sequence; identical to SEQ ID NO: 80505
  derived and/or modified sequence opt1 from neuraminidase__InfluenzaA__ADM14767

SEQ ID NO: 80507 - RNA, 1410 nt, Artificial Sequence; identical to SEQ ID NO: 77746
  derived and/or modified sequence opt1 from neuraminidase__InfluenzaA__ADM14777

SEQ ID NO: 80508 - RNA, 1410 nt, Artificial Sequence; identical to SEQ ID NO: 77746
  derived and/or modified sequence opt1 from neuraminidase__InfluenzaA__ADM14814

SEQ ID NO: 80509 - RNA, 1410 nt, Artificial Sequence; identical to SEQ ID NO: 77746
  derived and/or modified sequence opt1 from neuraminidase__InfluenzaA__ADM14823

SEQ ID NO: 80510 - RNA, 1410 nt, Artificial Sequence; identical to SEQ ID NO: 79369
  derived and/or modified sequence opt1 from neuraminidase__InfluenzaA__ADM14841

SEQ ID NO: 80511 - RNA, 1410 nt, Artificial Sequence; identical to SEQ ID NO: 79369
  derived and/or modified sequence opt1 from neuraminidase__InfluenzaA__ADM14859

SEQ ID NO: 80512 - RNA, 1410 nt, Artificial Sequence; identical to SEQ ID NO: 78883
  derived and/or modified sequence opt1 from neuraminidase__InfluenzaA__ADM14868

SEQ ID NO: 80513 - RNA, 1410 nt, Artificial Sequence; identical to SEQ ID NO: 79369
  derived and/or modified sequence opt1 from neuraminidase__InfluenzaA__ADM14878

SEQ ID NO: 80514 - RNA, 1410 nt, Artificial Sequence; identical to SEQ ID NO: 77746
  derived and/or modified sequence opt1 from neuraminidase__InfluenzaA__ADM14887

SEQ ID NO: 80515 - RNA, 1410 nt, Artificial Sequence
  derived and/or modified sequence opt1 from neuraminidase__InfluenzaA__ADM14896
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacgugcuggugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80516 - RNA, 1410 nt, Artificial Sequence; identical to SEQ ID NO: 77746
  derived and/or modified sequence opt1 from neuraminidase__InfluenzaA__ADM14905

SEQ ID NO: 80517 - RNA, 1410 nt, Artificial Sequence; identical to SEQ ID NO: 77746
  derived and/or modified sequence opt1 from neuraminidase__InfluenzaA__ADM14923

SEQ ID NO: 80518 - RNA, 1410 nt, Artificial Sequence; identical to SEQ ID NO: 79034
  derived and/or modified sequence opt1 from neuraminidase__InfluenzaA__ADM14932

SEQ ID NO: 80519 - RNA, 1410 nt, Artificial Sequence; identical to SEQ ID NO: 77746
  derived and/or modified sequence opt1 from neuraminidase__InfluenzaA__ADM14950

SEQ ID NO: 80520 - RNA, 1410 nt, Artificial Sequence; identical to SEQ ID NO: 78764
  derived and/or modified sequence opt1 from neuraminidase__InfluenzaA__ADM14959

SEQ ID NO: 80521 - RNA, 1410 nt, Artificial Sequence
  derived and/or modified sequence opt1 from neuraminidase__InfluenzaA__ADM14977
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucccgguucgagagcguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 80522 - RNA, 1410 nt, Artificial Sequence; identical to SEQ ID NO: 79369
  derived and/or modified sequence opt1 from neuraminidase__InfluenzaA__ADM14987

SEQ ID NO: 80523 - RNA, 1410 nt, Artificial Sequence; identical to SEQ ID NO: 78913
  derived and/or modified sequence opt1 from neuraminidase__InfluenzaA__ADM26787

SEQ ID NO: 80524 - RNA, 1410 nt, Artificial Sequence; identical to SEQ ID NO: 79492
  derived and/or modified sequence opt1 from neuraminidase__InfluenzaA__ADM26798

SEQ ID NO: 80525 - RNA, 1410 nt, Artificial Sequence
  derived and/or modified sequence opt1 from neuraminidase__InfluenzaA__ADM26809
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacggugaacaacguccacuccaacaacaccgugcgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcucggcuacgagaccuucaaggugaucgagggguggagcaaccacaaguccaagcugcagaucaaccgccaggugaucgucgaccggggcaaccgcagcggguacuccggcaucuucagcguggagggcaagagcugcaucaaccggugcuucuacguggagcugauccgcgggcggaaggaggagaccgagguccucuggaccuccaacagcaucgugguguucugcggcaccuccgggacguacggcaccgggagcuggcccgacggcgccgaccugaaccugaugccgaucuga

SEQ ID NO: 80526 - RNA, 1410 nt, Artificial Sequence
  derived and/or modified sequence opt1 from neuraminidase__InfluenzaA__ADM26820
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 80527 - RNA, 1350 nt, Artificial Sequence
  derived and/or modified sequence opt1 from neuraminidase__InfluenzaA__ADM31427
augaaccccaaccagaagaucaucaccaucggcagcgugugcaugaucaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccauccgggggugggccgugcacagcaaggacaacuccauccgcaucggcagcaagggcgacguguucgucauccgggagcccuucaucuccugcagccacauggagugccgcaccuucuuccugacgcagggggcccugcucaacgacaagcacuccaacggcaccgugaaggaccggagcccccaccgcacccugauguccugcccggugggggaggcccccagccccuacaacucccgguucgagagcgucgcgugguccgccagcgccugccacgacggcaucagcuggcugaccaucgggaucuccggccccgacaacggcgccguggcggugcucaaguacaacgggaucaucacggacaccaucaagagcuggggcaacaacauccugcgcacccaggaguccgagugcgccugcgucaacgggagcugcuucaccgugaugacggacggcccguccaacggccaggccagcuacaagaucuucaagaucgagaaggggaagguggucaaguccguggagcugaacgcccccaacuaccacuacgaggagugcagcugcuaccccgacuccggcgagaucaucugcgugugccgggacaacuggcacgggagcaaccgccccugggucuccuucaaccagaaccucgaguaccagaucggcuacaucugcagcgggguguucggcgacaacccgcggcccaacgacggcaccggguccugcggccccaugagccccaacggggccuacggcaucaagggguucuccuucaaguacggcaacggcguguggaucgggcgcaccaagagcaccaacucccggagcggcuucgagaugaucugggacccgaacggguggacgggcaccgacuccgaguucagcgucaagcaggacaucguggcgaucaccgacuggagcggguacuccggcagcuucgugcagcaccccgagcugaccggccuggacugcauccgccccugcuucugggucgagcucauccgggggcgccccaaggaguccacgaucuggaccagcggcuccagcaucuccuucugcggggugaacagcgacaccgucuccuggagcuggccggacggcgccgagcugcccuucaccaucgacaaguga

SEQ ID NO: 80528 - RNA, 1410 nt, Artificial Sequence
  derived and/or modified sequence opt1 from neuraminidase__InfluenzaA__ADM31481
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaagggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80529 - RNA, 1410 nt, Artificial Sequence; identical to SEQ ID NO: 78329
  derived and/or modified sequence opt1 from neuraminidase__InfluenzaA__ADM31491

SEQ ID NO: 80530 - RNA, 1410 nt, Artificial Sequence; identical to SEQ ID NO: 79951
  derived and/or modified sequence opt1 from neuraminidase__InfluenzaA__ADM31501

SEQ ID NO: 80531 - RNA, 1410 nt, Artificial Sequence; identical to SEQ ID NO: 77746
  derived and/or modified sequence opt1 from neuraminidase__InfluenzaA__ADM31511

SEQ ID NO: 80532 - RNA, 1410 nt, Artificial Sequence; identical to SEQ ID NO: 79947
  derived and/or modified sequence opt1 from neuraminidase__InfluenzaA__ADM31521

SEQ ID NO: 80533 - RNA, 1410 nt, Artificial Sequence; identical to SEQ ID NO: 77746
  derived and/or modified sequence opt1 from neuraminidase__InfluenzaA__ADM31531

SEQ ID NO: 80534 - RNA, 1410 nt, Artificial Sequence; identical to SEQ ID NO: 79034
  derived and/or modified sequence opt1 from neuraminidase__InfluenzaA__ADM31541

SEQ ID NO: 80535 - RNA, 1410 nt, Artificial Sequence; identical to SEQ ID NO: 77746
  derived and/or modified sequence opt1 from neuraminidase__InfluenzaA__ADM31551

SEQ ID NO: 80536 - RNA, 1410 nt, Artificial Sequence; identical to SEQ ID NO: 77746
  derived and/or modified sequence opt1 from neuraminidase__InfluenzaA__ADM31561

SEQ ID NO: 80537 - RNA, 1410 nt, Artificial Sequence; identical to SEQ ID NO: 77746
  derived and/or modified sequence opt1 from neuraminidase__InfluenzaA__ADM31571

SEQ ID NO: 80538 - RNA, 1410 nt, Artificial Sequence; identical to SEQ ID NO: 78923
  derived and/or modified sequence opt1 from neuraminidase__InfluenzaA__ADM31581

SEQ ID NO: 80539 - RNA, 1410 nt, Artificial Sequence; identical to SEQ ID NO: 77746
  derived and/or modified sequence opt1 from neuraminidase__InfluenzaA__ADM31601

SEQ ID NO: 80540 - RNA, 1410 nt, Artificial Sequence; identical to SEQ ID NO: 79034
  derived and/or modified sequence opt1 from neuraminidase__InfluenzaA__ADM31611

SEQ ID NO: 80541 - RNA, 1410 nt, Artificial Sequence
  derived and/or modified sequence opt1 from neuraminidase__InfluenzaA__ADM31621
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcuccagccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 80542 - RNA, 1410 nt, Artificial Sequence; identical to SEQ ID NO: 79034
  derived and/or modified sequence opt1 from neuraminidase__InfluenzaA__ADM31631

SEQ ID NO: 80543 - RNA, 1410 nt, Artificial Sequence; identical to SEQ ID NO: 78923
  derived and/or modified sequence opt1 from neuraminidase__InfluenzaA__ADM31641

SEQ ID NO: 80544 - RNA, 1410 nt, Artificial Sequence; identical to SEQ ID NO: 79208
  derived and/or modified sequence opt1 from neuraminidase__InfluenzaA__ADM31651

SEQ ID NO: 80545 - RNA, 1410 nt, Artificial Sequence; identical to SEQ ID NO: 78923
  derived and/or modified sequence opt1 from neuraminidase__InfluenzaA__ADM31661

SEQ ID NO: 80546 - RNA, 1410 nt, Artificial Sequence
  derived and/or modified sequence opt1 from neuraminidase__InfluenzaA__ADM31671
augaaccccaaccagaagaucaucaccaucggcagcgugugcaugaccaucgggauggccaaccugauccuccagaucggcaacaucaucuccaucuggaucagccacuccacgcagcuggggaaccagaaccagaucgagaccugcaaccagagcgucaucaccuacgagaacaacaccugggugaaccagacguacgugaacaucuccaacaccaacuucgccgcgggccagagcgucguguccgccaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgcggagcugccguucaccaucgacaaguga

SEQ ID NO: 80547 - RNA, 1410 nt, Artificial Sequence; identical to SEQ ID NO: 79034
  derived and/or modified sequence opt1 from neuraminidase__InfluenzaA__ADM31681

SEQ ID NO: 80548 - RNA, 1410 nt, Artificial Sequence
  derived and/or modified sequence opt1 from neuraminidase__InfluenzaA__ADM31691
augaaccccaaccagaagauccugaccaucggcagcgugugcaugaccaucgggauggccaaccucauccugcagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccucgacugcauccgccccugcuucugggucgagcugauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80549 - RNA, 1410 nt, Artificial Sequence; identical to SEQ ID NO: 77746
  derived and/or modified sequence opt1 from neuraminidase__InfluenzaA__ADM31701

SEQ ID NO: 80550 - RNA, 1410 nt, Artificial Sequence; identical to SEQ ID NO: 77746
  derived and/or modified sequence opt1 from neuraminidase__InfluenzaA__ADM31711

SEQ ID NO: 80551 - RNA, 1410 nt, Artificial Sequence; identical to SEQ ID NO: 79034
  derived and/or modified sequence opt1 from neuraminidase__InfluenzaA__ADM31721

SEQ ID NO: 80552 - RNA, 1410 nt, Artificial Sequence
  derived and/or modified sequence opt1 from neuraminidase__InfluenzaA__ADM31731
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggcggaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgccgagcugccguucaccaucgacaaguga

SEQ ID NO: 80553 - RNA, 1410 nt, Artificial Sequence; identical to SEQ ID NO: 80121
  derived and/or modified sequence opt1 from neuraminidase__InfluenzaA__ADM31741

SEQ ID NO: 80554 - RNA, 1410 nt, Artificial Sequence; identical to SEQ ID NO: 77746
  derived and/or modified sequence opt1 from neuraminidase__InfluenzaA__ADM31751

SEQ ID NO: 80555 - RNA, 1410 nt, Artificial Sequence
  derived and/or modified sequence opt1 from neuraminidase__InfluenzaA__ADM31761
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccacaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucuccgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80556 - RNA, 1410 nt, Artificial Sequence
  derived and/or modified sequence opt1 from neuraminidase__InfluenzaA__ADM31771
augaaccccaaccagaagauccugaccaucggcagcgugugcaugaccaucgggauggccaaccucauccugcagaucggcaacaucaucuccaucuggaucagccacuccauccagcuggggaaccagaaccagacggagaccugcaaccagagcgucaucaucuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80557 - RNA, 1410 nt, Artificial Sequence
  derived and/or modified sequence opt1 from neuraminidase__InfluenzaA__ADM31801
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucaacaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaaguucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80558 - RNA, 1410 nt, Artificial Sequence
  derived and/or modified sequence opt1 from neuraminidase__InfluenzaA__ADM31811
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80559 - RNA, 1410 nt, Artificial Sequence; identical to SEQ ID NO: 78923
  derived and/or modified sequence opt1 from neuraminidase__InfluenzaA__ADM31821

SEQ ID NO: 80560 - RNA, 1410 nt, Artificial Sequence; identical to SEQ ID NO: 77746
  derived and/or modified sequence opt1 from neuraminidase__InfluenzaA__ADM31831

SEQ ID NO: 80561 - RNA, 1410 nt, Artificial Sequence; identical to SEQ ID NO: 77746
  derived and/or modified sequence opt1 from neuraminidase__InfluenzaA__ADM31841

SEQ ID NO: 80562 - RNA, 1410 nt, Artificial Sequence
  derived and/or modified sequence opt1 from neuraminidase__InfluenzaA__ADM31851
augaaccccaaccagaagauccugaccaucggcagcgugugcaugaccaucgggauggccaaccucauccugcagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgcgugcgugaacgggagcugcuucaccgugaugaccgacggcccguccgacggccaggccagcuacaagaucuuccgcaucgagcgggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccuggaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucguggggaucaacgagugguccggcuacagcggguccuucgugcagcacccggagcugaccggccucgacugcauccggcccugcuucugggucgagcugauccgcggccggcccaaggagaacaccaucuggaccagcggguccagcaucuccuucugcggcgugaacagcgacacggucgggugguccuggcccgacggcgccgagcugccguucaccaucgacaaguga

SEQ ID NO: 80563 - RNA, 1410 nt, Artificial Sequence; identical to SEQ ID NO: 77746
  derived and/or modified sequence opt1 from neuraminidase__InfluenzaA__ADM31861

SEQ ID NO: 80564 - RNA, 1410 nt, Artificial Sequence; identical to SEQ ID NO: 77746
  derived and/or modified sequence opt1 from neuraminidase__InfluenzaA__ADM31871

SEQ ID NO: 80565 - RNA, 1410 nt, Artificial Sequence
  derived and/or modified sequence opt1 from neuraminidase__InfluenzaA__ADM31881
augaaccccaaccagaagaucaucaccaucggcagcgugugcaugaccaucgggauggccaaccugauccuccagaucggcaacacgaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80566 - RNA, 1410 nt, Artificial Sequence; identical to SEQ ID NO: 77746
  derived and/or modified sequence opt1 from neuraminidase__InfluenzaA__ADM31891

SEQ ID NO: 80567 - RNA, 1410 nt, Artificial Sequence; identical to SEQ ID NO: 77736
  derived and/or modified sequence opt1 from neuraminidase__InfluenzaA__ADM31901

SEQ ID NO: 80568 - RNA, 1410 nt, Artificial Sequence; identical to SEQ ID NO: 78969
  derived and/or modified sequence opt1 from neuraminidase__InfluenzaA__ADM31911

SEQ ID NO: 80569 - RNA, 1410 nt, Artificial Sequence; identical to SEQ ID NO: 78969
  derived and/or modified sequence opt1 from neuraminidase__InfluenzaA__ADM31921

SEQ ID NO: 80570 - RNA, 1410 nt, Artificial Sequence; identical to SEQ ID NO: 79427
  derived and/or modified sequence opt1 from neuraminidase__InfluenzaA__ADM31931

SEQ ID NO: 80571 - RNA, 1410 nt, Artificial Sequence; identical to SEQ ID NO: 77736
  derived and/or modified sequence opt1 from neuraminidase__InfluenzaA__ADM31941

SEQ ID NO: 80572 - RNA, 1410 nt, Artificial Sequence; identical to SEQ ID NO: 79427
  derived and/or modified sequence opt1 from neuraminidase__InfluenzaA__ADM31951

SEQ ID NO: 80573 - RNA, 1410 nt, Artificial Sequence
  derived and/or modified sequence opt1 from neuraminidase__InfluenzaA__ADM31961
augaaccccaaccagaagaucaucaccaucggcagcgugugcauggccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 80574 - RNA, 1410 nt, Artificial Sequence
  derived and/or modified sequence opt1 from neuraminidase__InfluenzaA__ADM31971
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcgugaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80575 - RNA, 1410 nt, Artificial Sequence; identical to SEQ ID NO: 78969
  derived and/or modified sequence opt1 from neuraminidase__InfluenzaA__ADM31981

SEQ ID NO: 80576 - RNA, 1410 nt, Artificial Sequence; identical to SEQ ID NO: 77736
  derived and/or modified sequence opt1 from neuraminidase__InfluenzaA__ADM31991

SEQ ID NO: 80577 - RNA, 1410 nt, Artificial Sequence; identical to SEQ ID NO: 77736
  derived and/or modified sequence opt1 from neuraminidase__InfluenzaA__ADM32001

SEQ ID NO: 80578 - RNA, 1410 nt, Artificial Sequence; identical to SEQ ID NO: 77736
  derived and/or modified sequence opt1 from neuraminidase__InfluenzaA__ADM32011

SEQ ID NO: 80579 - RNA, 1410 nt, Artificial Sequence; identical to SEQ ID NO: 77746
  derived and/or modified sequence opt1 from neuraminidase__InfluenzaA__ADM32021

SEQ ID NO: 80580 - RNA, 1410 nt, Artificial Sequence; identical to SEQ ID NO: 78716
  derived and/or modified sequence opt1 from neuraminidase__InfluenzaA__ADM32031

SEQ ID NO: 80581 - RNA, 1410 nt, Artificial Sequence; identical to SEQ ID NO: 79470
  derived and/or modified sequence opt1 from neuraminidase__InfluenzaA__ADM32051

SEQ ID NO: 80582 - RNA, 1410 nt, Artificial Sequence; identical to SEQ ID NO: 77746
  derived and/or modified sequence opt1 from neuraminidase__InfluenzaA__ADM32061

SEQ ID NO: 80583 - RNA, 1410 nt, Artificial Sequence; identical to SEQ ID NO: 77746
  derived and/or modified sequence opt1 from neuraminidase__InfluenzaA__ADM32071

SEQ ID NO: 80584 - RNA, 1410 nt, Artificial Sequence; identical to SEQ ID NO: 77746
  derived and/or modified sequence opt1 from neuraminidase__InfluenzaA__ADM32081

SEQ ID NO: 80585 - RNA, 1410 nt, Artificial Sequence; identical to SEQ ID NO: 78969
  derived and/or modified sequence opt1 from neuraminidase__InfluenzaA__ADM32091

SEQ ID NO: 80586 - RNA, 1410 nt, Artificial Sequence; identical to SEQ ID NO: 77746
  derived and/or modified sequence opt1 from neuraminidase__InfluenzaA__ADM32101

SEQ ID NO: 80587 - RNA, 1410 nt, Artificial Sequence; identical to SEQ ID NO: 77746
  derived and/or modified sequence opt1 from neuraminidase__InfluenzaA__ADM32111

SEQ ID NO: 80588 - RNA, 1410 nt, Artificial Sequence; identical to SEQ ID NO: 79427
  derived and/or modified sequence opt1 from neuraminidase__InfluenzaA__ADM32554

SEQ ID NO: 80589 - RNA, 1410 nt, Artificial Sequence; identical to SEQ ID NO: 77736
  derived and/or modified sequence opt1 from neuraminidase__InfluenzaA__ADM32564

SEQ ID NO: 80590 - RNA, 1410 nt, Artificial Sequence; identical to SEQ ID NO: 78969
  derived and/or modified sequence opt1 from neuraminidase__InfluenzaA__ADM32574

SEQ ID NO: 80591 - RNA, 1410 nt, Artificial Sequence; identical to SEQ ID NO: 77746
  derived and/or modified sequence opt1 from neuraminidase__InfluenzaA__ADM32584

SEQ ID NO: 80592 - RNA, 1410 nt, Artificial Sequence; identical to SEQ ID NO: 79427
  derived and/or modified sequence opt1 from neuraminidase__InfluenzaA__ADM32594

SEQ ID NO: 80593 - RNA, 1410 nt, Artificial Sequence; identical to SEQ ID NO: 77746
  derived and/or modified sequence opt1 from neuraminidase__InfluenzaA__ADM32604

SEQ ID NO: 80594 - RNA, 1410 nt, Artificial Sequence; identical to SEQ ID NO: 77746
  derived and/or modified sequence opt1 from neuraminidase__InfluenzaA__ADM32614

SEQ ID NO: 80595 - RNA, 1410 nt, Artificial Sequence; identical to SEQ ID NO: 77746
  derived and/or modified sequence opt1 from neuraminidase__InfluenzaA__ADM32624

SEQ ID NO: 80596 - RNA, 1410 nt, Artificial Sequence; identical to SEQ ID NO: 79427
  derived and/or modified sequence opt1 from neuraminidase__InfluenzaA__ADM32634

SEQ ID NO: 80597 - RNA, 1410 nt, Artificial Sequence; identical to SEQ ID NO: 77746
  derived and/or modified sequence opt1 from neuraminidase__InfluenzaA__ADM32644

SEQ ID NO: 80598 - RNA, 1410 nt, Artificial Sequence; identical to SEQ ID NO: 77746
  derived and/or modified sequence opt1 from neuraminidase__InfluenzaA__ADM32664

SEQ ID NO: 80599 - RNA, 1410 nt, Artificial Sequence; identical to SEQ ID NO: 78969
  derived and/or modified sequence opt1 from neuraminidase__InfluenzaA__ADM32674

SEQ ID NO: 80600 - RNA, 1410 nt, Artificial Sequence; identical to SEQ ID NO: 77746
  derived and/or modified sequence opt1 from neuraminidase__InfluenzaA__ADM32684

SEQ ID NO: 80601 - RNA, 1410 nt, Artificial Sequence; identical to SEQ ID NO: 77736
  derived and/or modified sequence opt1 from neuraminidase__InfluenzaA__ADM32694

SEQ ID NO: 80602 - RNA, 1410 nt, Artificial Sequence; identical to SEQ ID NO: 77746
  derived and/or modified sequence opt1 from neuraminidase__InfluenzaA__ADM32704

SEQ ID NO: 80603 - RNA, 1410 nt, Artificial Sequence; identical to SEQ ID NO: 79470
  derived and/or modified sequence opt1 from neuraminidase__InfluenzaA__ADM32714

SEQ ID NO: 80604 - RNA, 1410 nt, Artificial Sequence; identical to SEQ ID NO: 79470
  derived and/or modified sequence opt1 from neuraminidase__InfluenzaA__ADM32724

SEQ ID NO: 80605 - RNA, 1410 nt, Artificial Sequence; identical to SEQ ID NO: 77746
  derived and/or modified sequence opt1 from neuraminidase__InfluenzaA__ADM32734

SEQ ID NO: 80606 - RNA, 1410 nt, Artificial Sequence; identical to SEQ ID NO: 78969
  derived and/or modified sequence opt1 from neuraminidase__InfluenzaA__ADM32744

SEQ ID NO: 80607 - RNA, 1410 nt, Artificial Sequence; identical to SEQ ID NO: 79470
  derived and/or modified sequence opt1 from neuraminidase__InfluenzaA__ADM32754

SEQ ID NO: 80608 - RNA, 1410 nt, Artificial Sequence; identical to SEQ ID NO: 78969
  derived and/or modified sequence opt1 from neuraminidase__InfluenzaA__ADM32764

SEQ ID NO: 80609 - RNA, 1410 nt, Artificial Sequence
  derived and/or modified sequence opt1 from neuraminidase__InfluenzaA__ADM32774
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucacgaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80610 - RNA, 1410 nt, Artificial Sequence; identical to SEQ ID NO: 78716
  derived and/or modified sequence opt1 from neuraminidase__InfluenzaA__ADM32784

SEQ ID NO: 80611 - RNA, 1410 nt, Artificial Sequence; identical to SEQ ID NO: 78969
  derived and/or modified sequence opt1 from neuraminidase__InfluenzaA__ADM32794

SEQ ID NO: 80612 - RNA, 1410 nt, Artificial Sequence
  derived and/or modified sequence opt1 from neuraminidase__InfluenzaA__ADM32804
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgagaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgugggcugguccuggcccgacggggccgagcugccguucacgaucgacaaguga

SEQ ID NO: 80613 - RNA, 1410 nt, Artificial Sequence
  derived and/or modified sequence opt1 from neuraminidase__InfluenzaA__ADM32814
augaaccccaaccagaagaucaucaccaucggcagcgugugcaugaccaucgggauggccaaccugauccuccagaucggcaacaucaucuccaucuggaucagccacuccauccagcuggggaaccagaaccaggucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80614 - RNA, 1410 nt, Artificial Sequence; identical to SEQ ID NO: 77746
  derived and/or modified sequence opt1 from neuraminidase__InfluenzaA__ADM32824

SEQ ID NO: 80615 - RNA, 1410 nt, Artificial Sequence; identical to SEQ ID NO: 78969
  derived and/or modified sequence opt1 from neuraminidase__InfluenzaA__ADM32834

SEQ ID NO: 80616 - RNA, 1410 nt, Artificial Sequence; identical to SEQ ID NO: 77736
  derived and/or modified sequence opt1 from neuraminidase__InfluenzaA__ADM32844

SEQ ID NO: 80617 - RNA, 1410 nt, Artificial Sequence
  derived and/or modified sequence opt1 from neuraminidase__InfluenzaA__ADM32854
augaaccccaaccagaagaucaucaccaucggcagcgugugcaccacgaucgggauggccaaccugauccuccagaucggcaacaucaucuccaucuggaucagccacuccauccaguucgggaaccagaaccagaucgagaccugcaaccagagcgucaucaccuacgagaacaacaccugggugaaccagacguacgugaacaucuccaacaccaacuucgccgcgggccagagcgucguguccgugaagcuggucgggaacagcucccugugcccggugagcggcugggccaucuacuccaaggacaacagcgugcgcaucggcuccaagggggacgucuucgugauccgggagcccuucaucagcugcagcccccucgagugccgcaccuucuuccugacccagggcgcccugcucaacgacaagcacuccaacgggacgaucaaggaccggucccccuaccgcacccugaugagcugcccgaucggcgaggugcccucccccuacaacagccgguucgagagcgucgccugguccgccagcgcgugccacgacgggaucaacuggcugaccaucggcaucuccggccccgacaacggggccguggccgugcucaaguacaacggcaucaucaccgacacgaucaagagcuggcgcaacaacauccugcggacccaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcacggacaacaacuucagcaucaagcaggacaucgucgggaucaacgagugguccggcuacagcggguccuucgugcagcacccggagcucaccggccuggacugcauccgccccugcuucugggucgagcugauccggggccgccccaaggagaacaccaucuggaccagcggguccagcaucuccuucugcggcgugaacagcgacacgguggggugguccuggcccgacggcgccgagcucccguucaccaucgacaaguga

SEQ ID NO: 80618 - RNA, 1410 nt, Artificial Sequence; identical to SEQ ID NO: 77736
  derived and/or modified sequence opt1 from neuraminidase__InfluenzaA__ADM32864

SEQ ID NO: 80619 - RNA, 1410 nt, Artificial Sequence; identical to SEQ ID NO: 77746
  derived and/or modified sequence opt1 from neuraminidase__InfluenzaA__ADM32874

SEQ ID NO: 80620 - RNA, 1410 nt, Artificial Sequence
  derived and/or modified sequence opt1 from neuraminidase__InfluenzaA__ADM32884
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgucggccagagcgugguguccgucaagcuggcggggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80621 - RNA, 1410 nt, Artificial Sequence; identical to SEQ ID NO: 77746
  derived and/or modified sequence opt1 from neuraminidase__InfluenzaA__ADM32921

SEQ ID NO: 80622 - RNA, 1410 nt, Artificial Sequence; identical to SEQ ID NO: 77746
  derived and/or modified sequence opt1 from neuraminidase__InfluenzaA__ADM32931

SEQ ID NO: 80623 - RNA, 1410 nt, Artificial Sequence
  derived and/or modified sequence opt1 from neuraminidase__InfluenzaA__ADM32941
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucaacagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 80624 - RNA, 1410 nt, Artificial Sequence; identical to SEQ ID NO: 77746
  derived and/or modified sequence opt1 from neuraminidase__InfluenzaA__ADM32951

SEQ ID NO: 80625 - RNA, 1410 nt, Artificial Sequence; identical to SEQ ID NO: 78329
  derived and/or modified sequence opt1 from neuraminidase__InfluenzaA__ADM32960

SEQ ID NO: 80626 - RNA, 1410 nt, Artificial Sequence; identical to SEQ ID NO: 77746
  derived and/or modified sequence opt1 from neuraminidase__InfluenzaA__ADM32969

SEQ ID NO: 80627 - RNA, 1410 nt, Artificial Sequence; identical to SEQ ID NO: 77746
  derived and/or modified sequence opt1 from neuraminidase__InfluenzaA__ADM32979

SEQ ID NO: 80628 - RNA, 1410 nt, Artificial Sequence; identical to SEQ ID NO: 79648
  derived and/or modified sequence opt1 from neuraminidase__InfluenzaA__ADM32988

SEQ ID NO: 80629 - RNA, 1410 nt, Artificial Sequence; identical to SEQ ID NO: 79648
  derived and/or modified sequence opt1 from neuraminidase__InfluenzaA__ADM32997

SEQ ID NO: 80630 - RNA, 1410 nt, Artificial Sequence; identical to SEQ ID NO: 77746
  derived and/or modified sequence opt1 from neuraminidase__InfluenzaA__ADM33006

SEQ ID NO: 80631 - RNA, 1410 nt, Artificial Sequence; identical to SEQ ID NO: 79648
  derived and/or modified sequence opt1 from neuraminidase__InfluenzaA__ADM33015

SEQ ID NO: 80632 - RNA, 1410 nt, Artificial Sequence
  derived and/or modified sequence opt1 from neuraminidase__InfluenzaA__ADM33025
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcuccaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80633 - RNA, 1410 nt, Artificial Sequence; identical to SEQ ID NO: 77746
  derived and/or modified sequence opt1 from neuraminidase__InfluenzaA__ADM33042

SEQ ID NO: 80634 - RNA, 1410 nt, Artificial Sequence; identical to SEQ ID NO: 77746
  derived and/or modified sequence opt1 from neuraminidase__InfluenzaA__ADM33062

SEQ ID NO: 80635 - RNA, 1410 nt, Artificial Sequence
  derived and/or modified sequence opt1 from neuraminidase__InfluenzaA__ADM33071
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcaagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacggggacaccgucggcuggagcuggcccgacggcgccgagcugccguucacgaucgacaaguga

SEQ ID NO: 80636 - RNA, 1410 nt, Artificial Sequence; identical to SEQ ID NO: 77746
  derived and/or modified sequence opt1 from neuraminidase__InfluenzaA__ADM33081

SEQ ID NO: 80637 - RNA, 1410 nt, Artificial Sequence; identical to SEQ ID NO: 78819
  derived and/or modified sequence opt1 from neuraminidase__InfluenzaA__ADM33091

SEQ ID NO: 80638 - RNA, 1410 nt, Artificial Sequence; identical to SEQ ID NO: 78819
  derived and/or modified sequence opt1 from neuraminidase__InfluenzaA__ADM33101

SEQ ID NO: 80639 - RNA, 1410 nt, Artificial Sequence; identical to SEQ ID NO: 78819
  derived and/or modified sequence opt1 from neuraminidase__InfluenzaA__ADM33111

SEQ ID NO: 80640 - RNA, 1410 nt, Artificial Sequence; identical to SEQ ID NO: 77746
  derived and/or modified sequence opt1 from neuraminidase__InfluenzaA__ADM33121

SEQ ID NO: 80641 - RNA, 1410 nt, Artificial Sequence; identical to SEQ ID NO: 77746
  derived and/or modified sequence opt1 from neuraminidase__InfluenzaA__ADM33130

SEQ ID NO: 80642 - RNA, 1410 nt, Artificial Sequence; identical to SEQ ID NO: 77746
  derived and/or modified sequence opt1 from neuraminidase__InfluenzaA__ADM33139

SEQ ID NO: 80643 - RNA, 1410 nt, Artificial Sequence; identical to SEQ ID NO: 77746
  derived and/or modified sequence opt1 from neuraminidase__InfluenzaA__ADM33149

SEQ ID NO: 80644 - RNA, 1410 nt, Artificial Sequence; identical to SEQ ID NO: 77746
  derived and/or modified sequence opt1 from neuraminidase__InfluenzaA__ADM33159

SEQ ID NO: 80645 - RNA, 1410 nt, Artificial Sequence; identical to SEQ ID NO: 77746
  derived and/or modified sequence opt1 from neuraminidase__InfluenzaA__ADM33169

SEQ ID NO: 80646 - RNA, 1410 nt, Artificial Sequence; identical to SEQ ID NO: 77746
  derived and/or modified sequence opt1 from neuraminidase__InfluenzaA__ADM33179

SEQ ID NO: 80647 - RNA, 1410 nt, Artificial Sequence; identical to SEQ ID NO: 77746
  derived and/or modified sequence opt1 from neuraminidase__InfluenzaA__ADM33188

SEQ ID NO: 80648 - RNA, 1410 nt, Artificial Sequence; identical to SEQ ID NO: 77746
  derived and/or modified sequence opt1 from neuraminidase__InfluenzaA__ADM33197

SEQ ID NO: 80649 - RNA, 1410 nt, Artificial Sequence; identical to SEQ ID NO: 77746
  derived and/or modified sequence opt1 from neuraminidase__InfluenzaA__ADM33206

SEQ ID NO: 80650 - RNA, 1410 nt, Artificial Sequence; identical to SEQ ID NO: 77746
  derived and/or modified sequence opt1 from neuraminidase__InfluenzaA__ADM33215

SEQ ID NO: 80651 - RNA, 1410 nt, Artificial Sequence; identical to SEQ ID NO: 77746
  derived and/or modified sequence opt1 from neuraminidase__InfluenzaA__ADM33224

SEQ ID NO: 80652 - RNA, 1410 nt, Artificial Sequence; identical to SEQ ID NO: 77746
  derived and/or modified sequence opt1 from neuraminidase__InfluenzaA__ADM33234

SEQ ID NO: 80653 - RNA, 1410 nt, Artificial Sequence; identical to SEQ ID NO: 78170
  derived and/or modified sequence opt1 from neuraminidase__InfluenzaA__ADM33243

SEQ ID NO: 80654 - RNA, 1410 nt, Artificial Sequence; identical to SEQ ID NO: 77746
  derived and/or modified sequence opt1 from neuraminidase__InfluenzaA__ADM33253

SEQ ID NO: 80655 - RNA, 1410 nt, Artificial Sequence; identical to SEQ ID NO: 78170
  derived and/or modified sequence opt1 from neuraminidase__InfluenzaA__ADM33262

SEQ ID NO: 80656 - RNA, 1410 nt, Artificial Sequence; identical to SEQ ID NO: 77776
  derived and/or modified sequence opt1 from neuraminidase__InfluenzaA__ADM33272

SEQ ID NO: 80657 - RNA, 1410 nt, Artificial Sequence; identical to SEQ ID NO: 77776
  derived and/or modified sequence opt1 from neuraminidase__InfluenzaA__ADM33282

SEQ ID NO: 80658 - RNA, 1410 nt, Artificial Sequence; identical to SEQ ID NO: 77746
  derived and/or modified sequence opt1 from neuraminidase__InfluenzaA__ADM33292

SEQ ID NO: 80659 - RNA, 1410 nt, Artificial Sequence; identical to SEQ ID NO: 77746
  derived and/or modified sequence opt1 from neuraminidase__InfluenzaA__ADM33302

SEQ ID NO: 80660 - RNA, 1410 nt, Artificial Sequence; identical to SEQ ID NO: 77736
  derived and/or modified sequence opt1 from neuraminidase__InfluenzaA__ADM33312

SEQ ID NO: 80661 - RNA, 1410 nt, Artificial Sequence; identical to SEQ ID NO: 77776
  derived and/or modified sequence opt1 from neuraminidase__InfluenzaA__ADM33322

SEQ ID NO: 80662 - RNA, 1410 nt, Artificial Sequence; identical to SEQ ID NO: 77776
  derived and/or modified sequence opt1 from neuraminidase__InfluenzaA__ADM33332

SEQ ID NO: 80663 - RNA, 1410 nt, Artificial Sequence; identical to SEQ ID NO: 77776
  derived and/or modified sequence opt1 from neuraminidase__InfluenzaA__ADM33342

SEQ ID NO: 80664 - RNA, 1410 nt, Artificial Sequence
  derived and/or modified sequence opt1 from neuraminidase__InfluenzaA__ADM33367
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucgugaccuacgagaacaacaccugggugaaccagaccuacgucaacaucuccaacacgaacuucgccgcgggccagagcgugguguccgucaagcuggccgggaacagcucccucugcccggugggcggcugggccaucuacagcaaggacaacuccgugcgcaucgggagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucccgguucgagagcgucgccuggagcgcguccgccugccacgacggcaucaacuggcucaccaucggcaucagcgggcccgacaacggcgccguggccgugcugaaguacaacgggaucaucaccgacaccaucaaguccuggcgcaacaacauccugcggacgcaggagagcgagugcgcgugcgucaacggcuccugcuucaccgugaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgucagcuccaacggcgccaacggggugaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgucggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgugggcuggagcuggcccgacggcgccgagcugccguucacgaucgacaaguga

SEQ ID NO: 80665 - RNA, 1410 nt, Artificial Sequence; identical to SEQ ID NO: 77776
  derived and/or modified sequence opt1 from neuraminidase__InfluenzaA__ADM33377

SEQ ID NO: 80666 - RNA, 1410 nt, Artificial Sequence; identical to SEQ ID NO: 77776
  derived and/or modified sequence opt1 from neuraminidase__InfluenzaA__ADM33387

SEQ ID NO: 80667 - RNA, 1410 nt, Artificial Sequence; identical to SEQ ID NO: 77746
  derived and/or modified sequence opt1 from neuraminidase__InfluenzaA__ADM33397

SEQ ID NO: 80668 - RNA, 1410 nt, Artificial Sequence; identical to SEQ ID NO: 77746
  derived and/or modified sequence opt1 from neuraminidase__InfluenzaA__ADM33407

SEQ ID NO: 80669 - RNA, 1410 nt, Artificial Sequence; identical to SEQ ID NO: 77776
  derived and/or modified sequence opt1 from neuraminidase__InfluenzaA__ADM33417

SEQ ID NO: 80670 - RNA, 1410 nt, Artificial Sequence; identical to SEQ ID NO: 77746
  derived and/or modified sequence opt1 from neuraminidase__InfluenzaA__ADM33427

SEQ ID NO: 80671 - RNA, 1410 nt, Artificial Sequence
  derived and/or modified sequence opt1 from neuraminidase__InfluenzaA__ADM33437
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccuccgccuacaacagccgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgccugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgcggagcugcccuucacgaucgacaaguga

SEQ ID NO: 80672 - RNA, 1410 nt, Artificial Sequence; identical to SEQ ID NO: 78100
  derived and/or modified sequence opt1 from neuraminidase__InfluenzaA__ADM33443

SEQ ID NO: 80673 - RNA, 1410 nt, Artificial Sequence; identical to SEQ ID NO: 77746
  derived and/or modified sequence opt1 from neuraminidase__InfluenzaA__ADM52446

SEQ ID NO: 80674 - RNA, 1410 nt, Artificial Sequence; identical to SEQ ID NO: 77746
  derived and/or modified sequence opt1 from neuraminidase__InfluenzaA__ADM52456

SEQ ID NO: 80675 - RNA, 1410 nt, Artificial Sequence; identical to SEQ ID NO: 79951
  derived and/or modified sequence opt1 from neuraminidase__InfluenzaA__ADM52466

SEQ ID NO: 80676 - RNA, 1410 nt, Artificial Sequence; identical to SEQ ID NO: 77746
  derived and/or modified sequence opt1 from neuraminidase__InfluenzaA__ADM52486

SEQ ID NO: 80677 - RNA, 1410 nt, Artificial Sequence; identical to SEQ ID NO: 77736
  derived and/or modified sequence opt1 from neuraminidase__InfluenzaA__ADM52496

SEQ ID NO: 80678 - RNA, 1410 nt, Artificial Sequence; identical to SEQ ID NO: 77746
  derived and/or modified sequence opt1 from neuraminidase__InfluenzaA__ADM52506

SEQ ID NO: 80679 - RNA, 1410 nt, Artificial Sequence; identical to SEQ ID NO: 77736
  derived and/or modified sequence opt1 from neuraminidase__InfluenzaA__ADM52516

SEQ ID NO: 80680 - RNA, 1410 nt, Artificial Sequence; identical to SEQ ID NO: 77736
  derived and/or modified sequence opt1 from neuraminidase__InfluenzaA__ADM52527

SEQ ID NO: 80681 - RNA, 1410 nt, Artificial Sequence; identical to SEQ ID NO: 78969
  derived and/or modified sequence opt1 from neuraminidase__InfluenzaA__ADM52537

SEQ ID NO: 80682 - RNA, 1410 nt, Artificial Sequence; identical to SEQ ID NO: 79470
  derived and/or modified sequence opt1 from neuraminidase__InfluenzaA__ADM52547

SEQ ID NO: 80683 - RNA, 1410 nt, Artificial Sequence; identical to SEQ ID NO: 77736
  derived and/or modified sequence opt1 from neuraminidase__InfluenzaA__ADM52557

SEQ ID NO: 80684 - RNA, 1410 nt, Artificial Sequence; identical to SEQ ID NO: 77736
  derived and/or modified sequence opt1 from neuraminidase__InfluenzaA__ADM52567

SEQ ID NO: 80685 - RNA, 1410 nt, Artificial Sequence; identical to SEQ ID NO: 77736
  derived and/or modified sequence opt1 from neuraminidase__InfluenzaA__ADM52577

SEQ ID NO: 80686 - RNA, 1410 nt, Artificial Sequence; identical to SEQ ID NO: 77746
  derived and/or modified sequence opt1 from neuraminidase__InfluenzaA__ADM52587

SEQ ID NO: 80687 - RNA, 1410 nt, Artificial Sequence; identical to SEQ ID NO: 77746
  derived and/or modified sequence opt1 from neuraminidase__InfluenzaA__ADM52597

SEQ ID NO: 80688 - RNA, 1410 nt, Artificial Sequence; identical to SEQ ID NO: 77736
  derived and/or modified sequence opt1 from neuraminidase__InfluenzaA__ADM52607

SEQ ID NO: 80689 - RNA, 1410 nt, Artificial Sequence; identical to SEQ ID NO: 77736
  derived and/or modified sequence opt1 from neuraminidase__InfluenzaA__ADM52617

SEQ ID NO: 80690 - RNA, 1410 nt, Artificial Sequence; identical to SEQ ID NO: 79427
  derived and/or modified sequence opt1 from neuraminidase__InfluenzaA__ADM52627

SEQ ID NO: 80691 - RNA, 1410 nt, Artificial Sequence; identical to SEQ ID NO: 78969
  derived and/or modified sequence opt1 from neuraminidase__InfluenzaA__ADM52637

SEQ ID NO: 80692 - RNA, 1410 nt, Artificial Sequence; identical to SEQ ID NO: 78969
  derived and/or modified sequence opt1 from neuraminidase__InfluenzaA__ADM52647

SEQ ID NO: 80693 - RNA, 1410 nt, Artificial Sequence; identical to SEQ ID NO: 77736
  derived and/or modified sequence opt1 from neuraminidase__InfluenzaA__ADM52657

SEQ ID NO: 80694 - RNA, 1410 nt, Artificial Sequence; identical to SEQ ID NO: 78969
  derived and/or modified sequence opt1 from neuraminidase__InfluenzaA__ADM52667

SEQ ID NO: 80695 - RNA, 1410 nt, Artificial Sequence; identical to SEQ ID NO: 77736
  derived and/or modified sequence opt1 from neuraminidase__InfluenzaA__ADM52687

SEQ ID NO: 80696 - RNA, 1410 nt, Artificial Sequence; identical to SEQ ID NO: 77736
  derived and/or modified sequence opt1 from neuraminidase__InfluenzaA__ADM52697

SEQ ID NO: 80697 - RNA, 1410 nt, Artificial Sequence; identical to SEQ ID NO: 79427
  derived and/or modified sequence opt1 from neuraminidase__InfluenzaA__ADM52707

SEQ ID NO: 80698 - RNA, 1410 nt, Artificial Sequence
  derived and/or modified sequence opt1 from neuraminidase__InfluenzaA__ADM52717
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgccgucuccgugaagcugguggggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80699 - RNA, 1410 nt, Artificial Sequence
  derived and/or modified sequence opt1 from neuraminidase__InfluenzaA__ADM86402
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccgucaaggaccggucccccuaccgcacgcugaugagcugcccgaucggcgaggugcccucccccuacaacagccgguucgagagcguggcgugguccgccagcgccugccacgacgggaucaacuggcucaccaucggcaucuccggccccgacaacggggccgucgcggugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 80700 - RNA, 1410 nt, Artificial Sequence; identical to SEQ ID NO: 77746
  derived and/or modified sequence opt1 from neuraminidase__InfluenzaA__ADM86412

SEQ ID NO: 80701 - RNA, 1410 nt, Artificial Sequence
  derived and/or modified sequence opt1 from neuraminidase__InfluenzaA__ADM86422
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgucgccggccagagcgugguguccgucaagcuggcggggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagguggugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 80702 - RNA, 1410 nt, Artificial Sequence; identical to SEQ ID NO: 78600
  derived and/or modified sequence opt1 from neuraminidase__InfluenzaA__ADM86432

SEQ ID NO: 80703 - RNA, 1410 nt, Artificial Sequence
  derived and/or modified sequence opt1 from neuraminidase__InfluenzaA__ADM86443
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaugaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80704 - RNA, 1410 nt, Artificial Sequence; identical to SEQ ID NO: 78329
  derived and/or modified sequence opt1 from neuraminidase__InfluenzaA__ADM86453

SEQ ID NO: 80705 - RNA, 1350 nt, Artificial Sequence
  derived and/or modified sequence opt1 from neuraminidase__InfluenzaA__ADM95377
augaaccccaaccagaagaucaucaccaucggcagcaucugcauggugaccgggaucgucucccugaugcuccaggugggcagcaugaucuccaucugggugagccacuccauccacacggggaaccagcaccaggccgagccgaucagcaacaccaacuuccugaccgagaaggccgucgcguccgugaagcuggccggcaacagcucccucugccccaucaacgggugggccguguacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccgaugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacggccaggccagccacaagaucuucaagauggagaagggcaaggugaucaaguccgucgagcucgacgcccccaacuaccacuacgaggagugcagcugcuaccccgacgccggggagaucacgugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgggcccguguccagcaacggcgcguacggggugaagggcuucuccuucaaguacgggaacggcgucuggaucggccggaccaagagcaccaacucccgcagcggguucgagaugaucugggaccccaacggcuggaccgagaccgacagccgguucuccgugaagcaggacaucguggccaucacggacuggagcggguacuccggcagcuucguccagcacccggagcugaccgggcucgacugcauccgccccugcuucuggguggagcugauccggggccgccccaaggaguccaccaucuggaccagcggcuccagcaucuccuucugcggggucaacagcgacacggugggcugguccuggcccgacggggccgagcugccguucaccaucgacaaguga

SEQ ID NO: 80706 - RNA, 1410 nt, Artificial Sequence; identical to SEQ ID NO: 77746
  derived and/or modified sequence opt1 from neuraminidase__InfluenzaA__ADM95650

SEQ ID NO: 80707 - RNA, 1410 nt, Artificial Sequence; identical to SEQ ID NO: 77746
  derived and/or modified sequence opt1 from neuraminidase__InfluenzaA__ADM95651

SEQ ID NO: 80708 - RNA, 1410 nt, Artificial Sequence
  derived and/or modified sequence opt1 from neuraminidase__InfluenzaA__ADM95652
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcaacugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcucacgggccuggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 80709 - RNA, 1410 nt, Artificial Sequence
  derived and/or modified sequence opt1 from neuraminidase__InfluenzaA__ADM95654
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggcacggcuucgagaugaucugggaccccaacggguggaccggcaccgacaacaacuucagcaucaagcaggacaucguggggacgaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80710 - RNA, 1410 nt, Artificial Sequence
  derived and/or modified sequence opt1 from neuraminidase__InfluenzaA__ADM95655
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccagcgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacgacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80711 - RNA, 1410 nt, Artificial Sequence; identical to SEQ ID NO: 79358
  derived and/or modified sequence opt1 from neuraminidase__InfluenzaA__ADM95656

SEQ ID NO: 80712 - RNA, 1410 nt, Artificial Sequence; identical to SEQ ID NO: 78923
  derived and/or modified sequence opt1 from neuraminidase__InfluenzaA__ADM95658

SEQ ID NO: 80713 - RNA, 1410 nt, Artificial Sequence
  derived and/or modified sequence opt1 from neuraminidase__InfluenzaA__ADM95659
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucaucgggacgaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 80714 - RNA, 1410 nt, Artificial Sequence; identical to SEQ ID NO: 77746
  derived and/or modified sequence opt1 from neuraminidase__InfluenzaA__ADM95660

SEQ ID NO: 80715 - RNA, 1410 nt, Artificial Sequence
  derived and/or modified sequence opt1 from neuraminidase__InfluenzaA__ADM95661
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacagcggguccuucgugcagcacccggagcugaccggccuggacugcauccgccccugcuucugggucgagcucauccggggccgccccaaggagaacaccaucuggaccagcggguccaucaucagcuucugcggcgugaacuccgacacggucggguggagcuggcccgacggcgccgagcugccguucaccaucgacaaguga

SEQ ID NO: 80716 - RNA, 1410 nt, Artificial Sequence; identical to SEQ ID NO: 79358
  derived and/or modified sequence opt1 from neuraminidase__InfluenzaA__ADM95662

SEQ ID NO: 80717 - RNA, 1410 nt, Artificial Sequence
  derived and/or modified sequence opt1 from neuraminidase__InfluenzaA__ADM95663
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcaucgagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggaccggcaccgacaacaacuucuccaucaagcaggacaucgucgggacgaacgaguggagcggcuacuccgggagcuucgugcagcacccggagcugaccggccuggacugcauccgccccugcuucuggguggagcucauccggggccgccccaaggagaacaccaucuggaccuccgggagcaucaucuccuucugcggcgucaacagcgacacgguggggugguccuggcccgacggcgccgagcugccguucaccaucgacaaguga

SEQ ID NO: 80718 - RNA, 1410 nt, Artificial Sequence; identical to SEQ ID NO: 79358
  derived and/or modified sequence opt1 from neuraminidase__InfluenzaA__ADM95664

SEQ ID NO: 80719 - RNA, 1410 nt, Artificial Sequence; identical to SEQ ID NO: 79358
  derived and/or modified sequence opt1 from neuraminidase__InfluenzaA__ADM95665

SEQ ID NO: 80720 - RNA, 1410 nt, Artificial Sequence
  derived and/or modified sequence opt1 from neuraminidase__InfluenzaA__ADM95666
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcaucuucggggacaacccgcgccccaacgacaagaccggcuccugcggccccgugagcuucaacggggccaacggcgugaagggguucuccuucaaguacggcaacggggucuggaucggccggaccaagagcaucuccagccgcaacggcuucgagaugaucugggaccccaacggguggaccggcaccgacaacaacuucagcaucaagcaggacaucguggggacgaacgagugguccggcuacagcggguccuucgugcagcacccggagcugaccggccuggacugcauccggcccugcuucugggucgagcucauccgcggccggcccaaggagaacaccaucuggaccagcggguccaucaucagcuucugcggcgugaacuccgacacggucggguggagcuggcccgacggcgccgagcugccguucaccaucgacaaguga

SEQ ID NO: 80721 - RNA, 1410 nt, Artificial Sequence; identical to SEQ ID NO: 79358
  derived and/or modified sequence opt1 from neuraminidase__InfluenzaA__ADM95667

SEQ ID NO: 80722 - RNA, 1410 nt, Artificial Sequence; identical to SEQ ID NO: 79358
  derived and/or modified sequence opt1 from neuraminidase__InfluenzaA__ADM95668

SEQ ID NO: 80723 - RNA, 1410 nt, Artificial Sequence; identical to SEQ ID NO: 77746
  derived and/or modified sequence opt1 from neuraminidase__InfluenzaA__ADM95669

SEQ ID NO: 80724 - RNA, 1410 nt, Artificial Sequence; identical to SEQ ID NO: 77746
  derived and/or modified sequence opt1 from neuraminidase__InfluenzaA__ADM95670

SEQ ID NO: 80725 - RNA, 1410 nt, Artificial Sequence
  derived and/or modified sequence opt1 from neuraminidase__InfluenzaA__ADM95672
augaaccccaaccagaagaucaucaccaucggcagcgugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaccaacgaguggagcggcuacuccgggagcuucgugcagcacccggagcugaccggccuggacugcauccgccccugcuucugggucgagcucauccggggccgccccaaggagaacaccaucuggacguccgggagcuccaucagcuucugcggcgugaacuccgacaccgucggguggagcuggcccgacggcgccgagcugccguucaccaucgacaaguga

SEQ ID NO: 80726 - RNA, 1410 nt, Artificial Sequence; identical to SEQ ID NO: 77746
  derived and/or modified sequence opt1 from neuraminidase__InfluenzaA__ADM95673

SEQ ID NO: 80727 - RNA, 1410 nt, Artificial Sequence; identical to SEQ ID NO: 79358
  derived and/or modified sequence opt1 from neuraminidase__InfluenzaA__ADM95674

SEQ ID NO: 80728 - RNA, 1410 nt, Artificial Sequence; identical to SEQ ID NO: 77746
  derived and/or modified sequence opt1 from neuraminidase__InfluenzaA__ADM95675

SEQ ID NO: 80729 - RNA, 1410 nt, Artificial Sequence
  derived and/or modified sequence opt1 from neuraminidase__InfluenzaA__ADM95677
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggacgaacgaguggagcggcuacuccgggagcuucgugcagcacccggagcugaccggccuggacugcauccgccccugcuucugggucgagcucauccggggccgccccaaggagaacaccaucuggaccuccgggagcaucaucuccuucugcggcgugaacagcgacacggucgggugguccuggcccgacggcgccgagcugccguucaccaucgacaaguga

SEQ ID NO: 80730 - RNA, 1410 nt, Artificial Sequence
  derived and/or modified sequence opt1 from neuraminidase__InfluenzaA__ADM95678
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 80731 - RNA, 1410 nt, Artificial Sequence; identical to SEQ ID NO: 80729
  derived and/or modified sequence opt1 from neuraminidase__InfluenzaA__ADM95679

SEQ ID NO: 80732 - RNA, 1410 nt, Artificial Sequence; identical to SEQ ID NO: 80729
  derived and/or modified sequence opt1 from neuraminidase__InfluenzaA__ADM95680

SEQ ID NO: 80733 - RNA, 1410 nt, Artificial Sequence; identical to SEQ ID NO: 77746
  derived and/or modified sequence opt1 from neuraminidase__InfluenzaA__ADM95681

SEQ ID NO: 80734 - RNA, 1410 nt, Artificial Sequence
  derived and/or modified sequence opt1 from neuraminidase__InfluenzaA__ADM95682
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagaucugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaccaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80735 - RNA, 1410 nt, Artificial Sequence
  derived and/or modified sequence opt1 from neuraminidase__InfluenzaA__ADM95683
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcauguccuucugcggcgugaacagcgacaccgucgggugguccuggcccgacggcgccgagcugccguucacgaucgacaaguga

SEQ ID NO: 80736 - RNA, 1410 nt, Artificial Sequence; identical to SEQ ID NO: 77746
  derived and/or modified sequence opt1 from neuraminidase__InfluenzaA__ADM95684

SEQ ID NO: 80737 - RNA, 1410 nt, Artificial Sequence
  derived and/or modified sequence opt1 from neuraminidase__InfluenzaA__ADM95685
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggcacggcuucgagaugaucugggaccccaacggguggaccggcaccgacaacaacuucagcaucaagcaggacaucguggggacgaacgagugguccggcuacagcggguccuucgugcagcacccggagcugaccggccuggacugcauccgccccugcuucugggucgagcucauccggggccgccccaaggagaacaccguguggaccagcggguccagcaucuccuucugcggcgucaacagcgacacgguggggugguccuggcccgacggcgccgagcugccguucaccaucgacaaguga

SEQ ID NO: 80738 - RNA, 1410 nt, Artificial Sequence
  derived and/or modified sequence opt1 from neuraminidase__InfluenzaA__ADM95686
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacgacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80739 - RNA, 1410 nt, Artificial Sequence; identical to SEQ ID NO: 77746
  derived and/or modified sequence opt1 from neuraminidase__InfluenzaA__ADM95687

SEQ ID NO: 80740 - RNA, 1410 nt, Artificial Sequence
  derived and/or modified sequence opt1 from neuraminidase__InfluenzaA__ADM95688
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacagcggguccuucgugcagcacccggagcugacccgccuggacugcauccggcccugcuucugggucgagcucauccgcggccggcccaaggagaacaccaucuggaccagcggcuccaucaucagcuucugcggggugaacuccgacacggucggcuggagcuggcccgacggggccgagcugccguucaccaucgacaaguga

SEQ ID NO: 80741 - RNA, 1410 nt, Artificial Sequence; identical to SEQ ID NO: 80738
  derived and/or modified sequence opt1 from neuraminidase__InfluenzaA__ADM95689

SEQ ID NO: 80742 - RNA, 1410 nt, Artificial Sequence
  derived and/or modified sequence opt1 from neuraminidase__InfluenzaA__ADM95690
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucaucgggacgaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 80743 - RNA, 1410 nt, Artificial Sequence; identical to SEQ ID NO: 77746
  derived and/or modified sequence opt1 from neuraminidase__InfluenzaA__ADM95691

SEQ ID NO: 80744 - RNA, 1410 nt, Artificial Sequence
  derived and/or modified sequence opt1 from neuraminidase__InfluenzaA__ADM95692
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucaucaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80745 - RNA, 1410 nt, Artificial Sequence; identical to SEQ ID NO: 77746
  derived and/or modified sequence opt1 from neuraminidase__InfluenzaA__ADM95693

SEQ ID NO: 80746 - RNA, 1410 nt, Artificial Sequence; identical to SEQ ID NO: 77746
  derived and/or modified sequence opt1 from neuraminidase__InfluenzaA__ADM95694

SEQ ID NO: 80747 - RNA, 1410 nt, Artificial Sequence; identical to SEQ ID NO: 77746
  derived and/or modified sequence opt1 from neuraminidase__InfluenzaA__ADM95695

SEQ ID NO: 80748 - RNA, 1410 nt, Artificial Sequence; identical to SEQ ID NO: 80738
  derived and/or modified sequence opt1 from neuraminidase__InfluenzaA__ADM95696

SEQ ID NO: 80749 - RNA, 1410 nt, Artificial Sequence; identical to SEQ ID NO: 79358
  derived and/or modified sequence opt1 from neuraminidase__InfluenzaA__ADM95697

SEQ ID NO: 80750 - RNA, 1413 nt, Artificial Sequence
  derived and/or modified sequence opt1 from neuraminidase__InfluenzaA__ADM95698
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacaacaccugggugaaccacaccuacgucaacaucaacaacacgaacgugguggcggaggaggacaagaccuccgucacccuggccgggaacagcucccugugcagcaucuccggcugggccaucuacaccaaggacaacagcauccggaucggcuccaagggggacguguucgugauccgcgagccguucaucagcugcucccaccucgagugccggacguucuuccugacccagggcgcccugcucaacgacaagcacagcaacgggaccgucaaggaccgcucccccuaccgggcccugaugagcugcccccugggcgaggcgcccuccccguacaacagcaaguucgagagcguggccugguccgccagcgccugccacgacgggaugggcuggcucaccaucggcaucuccgggcccgacaacggcgcgguggccguccugaaguacaacgggaucaucacgggcaccaucaagagcuggaagaagcagauccugcgcacccaggaguccgagugcgugugcaugaacggcagcugcuucaccaucaugacggacgggcccuccaacaaggccgccagcuacaagaucuucaagaucgagaagggcaaggugaccaaguccaucgagcucaacgcccccaacuuccacuacgaggagugcagcugcuacccggacaccgggaucgucaugugcgugugccgggacaacuggcacggcuccaaccgccccugggugagcuucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucagcgugaagcaggacgucguggccaucaccgacugguccggguacagcggcagcuucgugcagcaccccgagcucacggggcuggacugcauccggcccugcuucugggucgagcuggugcgcggccagccgcgggagaacaccaccaucuggaccuccggcagcuccaucagcuucugcggggucaacuccgacacggccaacuggagcuggcccgacggcgccgagcuccccuucaccaucgacaaguga

SEQ ID NO: 80751 - RNA, 1413 nt, Artificial Sequence
  derived and/or modified sequence opt1 from neuraminidase__InfluenzaA__ADM95699
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacaacaccugggugaaccacaccuacgucaacaucaacaacacgaacgugguggcggaggaggacaagaccuccgucacccuggccgggaacagcucccugugcagcaucuccggcugggccaucuacaccaaggacaacagcauccggaucggcuccaagggggacguguucgugauccgcgagccguucaucagcugcucccaccucgagugccggacguucuuccugacccagggcgcccugcucaacgacaagcacagcaacgggaccgucaaggaccgcucccccuaccgggcccugaugagcugcccccugggcgaggcgcccuccccguacaacagcaaguucgagagcguggccugguccgccagcgccugccacgacgggaugggcuggcucaccaucggcaucuccgggcccgacaacggcgcgguggccguccugaaguacaacgggaucaucacgggcaccaucaagagcuggaagaagcagauccugcgcacccaggaguccgagugcgugugcaugaacggcagcugcuucaccaucaugacggacgggcccuccaacaaggccgccagcuacaagaucuucaagaucgagaagggcaaggugaccaaguccaucgagcucaacgcccccaacuucuacuacgaggagugcagcugcuacccggacaccgggaucgucaugugcgugugccgggacaacuggcacggcuccaaccgccccugggugagcuucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucagcgugaagcaggacgucguggccaucaccgacugguccggguacagcggcagcuucgugcagcaccccgagcucacggggcuggacugcauccggcccugcuucugggucgagcuggugcgcggccucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 80752 - RNA, 1413 nt, Artificial Sequence
  derived and/or modified sequence opt1 from neuraminidase__InfluenzaA__ADM95701
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacaacaccugggugaaccacaccuacgucaacaucaacaacacgaacgugguggcggaggaggacaagaccuccgucacccuggccgggaacagcucccugugcagcaucuccggcugggccaucuacaccaaggacaacagcauccggaucggcuccaagggggacguguucgugauccgcgagccguucaucagcugcucccaccucgagugccggacguucuuccugacccagggcgcccugcucaacgacaagcacagcaacgggaccgucaaggaccgcucccccuaccgggcccugaugagcugcccccugggcgaggcgcccuccccguacaacagcaaguucgagagcguggccugguccgccagcgccugccacgacgggaugggcuggcucaccaucggcaucuccgggcccgacaacggcgcgguggccguccugaaguacaacgggaucaucacgggcaccaucaagagcuggaagaagcagauccugcgcacccaggaguccgagugcgugugcaugaacggcagcugcuucaccaucaugacggacgggcccuccaacaaggccgccagcuacaagaucuucaagaucgagaagggcaaggugaccaaguccaucgagcucaacgcccccaacuuccacuacgaggagugcagcugcuacccggacaccgggaucgucaugugcgugugccgggacaacuggcacggcuccaaccgccccugggugagcuucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucagcgugaagcaggacgucguggccaucaccgacugguccggguacagcggcagcuucgugcagcaccccgagcucacggggcuggacugcauccggcccugcuucugggucgagcuggugcgcggccucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 80753 - RNA, 1413 nt, Artificial Sequence
  derived and/or modified sequence opt1 from neuraminidase__InfluenzaA__ADM95702
augaaccccaaccagaagaucaucaccaucggcagcaucuccaucgccaucgggaucaucagccugaugcuccagaucggcaacaucaucuccaucugggccagccacuccauccagaccgggcgccagaacaacacgggcaucugcaaccagcggaucaucaccuacgagaacagcaccugggugaaccacaccuacgucaacaucaacaacacgaaggugguggcgggggaggacaagaccuccgucacccuggccggcaacagcucccugugcagcaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgaggugaucugggaccccaacggcuggacgaacaccgacuccgacuucagcgucaagcaggacgugguggccaucaccgacugguccggguacagcggcagcuucguccagcaccccgagcucacgggccuggacugcauccgccccugcuucuggguggagcugguccgggggcucccgcgcgagaacaccaccaucuggaccuccggcagcuccaucagcuucugcggggugaacuccgacacggccaacuggagcuggcccgacggcgccgagcugcccuucaccaucgacaaguga

SEQ ID NO: 80754 - RNA, 1413 nt, Artificial Sequence
  derived and/or modified sequence opt1 from neuraminidase__InfluenzaA__ADM95704
augaaccccaaccagaagaucaucaccaucggcagcaucuccaucgccaucgggaucaucagccugaugcuccagaucggcaacaucguguccaucugggccagccacuccauccagaccgggagccagaacaacacgggcaucugcaaccagcgcaucaucaccuacgagaacaacaccugggucaaccacaccuacgugaacaucaacaacacgaacguggucgcggaggaggacaagaccuccgugacccuggccgggaacagcucccugugcagcaucuccggcugggccaucuacaccaaggacaacagcauccggaucggcuccaagggggacguguucgucauccgcgagccguucaucagcugcucccaccucgagugccggacguucuuccugacccagggcgcccugcucaacgacaagcacagcaacgggaccgugaaggaccgcucccccuaccgggcccugaugagcugcccccugggcgaggcgcccuccccguacaacagcaaguucgagagcguggccugguccgccagcgccugccacgacgggaugggcuggcucaccaucggcaucuccgggcccgacaacggcgcggucgccgugcugaaguacaacgggaucaucacgggcaccaucaagagcuggaagaagcagauccugcgcacccaggaguccgagugcgugugcaugaacggcagcugcuucaccaucaugacggacgggcccuccaaccgggccgccagcuacaagaucuucaagaucgagaagggcaaggucaccaaguccaucgagcucaacgcccccaacuuccacuacgaggagugcagcugcuacccggacaccgggaucgugaugugcgugugccgcgacaacuggcacggcuccaaccggcccugggucagcuucaaccagaaccuggacuaccagaucggguacaucugcuccggcguguucggcgacaacccccgccccgaggacggggagggcagcugcaacccggugaccgucgacggggcgaacggcgugaagggguucuccuacaaguacgacaacggcguguggaucggccggaccaagagcaaccgccugcggaagggguucgagaugaucugggaccccaacggcuggacgaacaccgacuccgacuucagcgucaagcaggacgugguggccaucaccgacugguccggguacagcggcagcuucguccagcaccccgagcucacggggcuggacugcauccgccccugcuucuggguggagcugguccggggccucccgcgcgagaacaccaccaucuggaccuccggcagcuccaucagcuucugcggggugaacuccgacacggccaacuggagcuggcccgacggcgccgagcugcccuucaccaucgacaaguga

SEQ ID NO: 80755 - RNA, 1413 nt, Artificial Sequence
  derived and/or modified sequence opt1 from neuraminidase__InfluenzaA__ADM95705
augaaccccaaccagaagaucaucaccaucggcagcaucuccaucgccaucgggaucaucagccugaugcuccagaucggcaacaucaucuccaucugggccagccacuccauccagaccgggcgccagaacaacacgggcaucugcaaccagcggaucaucaccuacgagaacagcaccugggugaaccacaccuacgucaacaucaacaacacgaaggugguggcgggggaggacaagaccuccgucacccuggccggcaacagcucccugugcagcaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucagcgugaagcaggacgucguggccaucaccgacugguccggguacagcggcagcuucgugcagcaccccgagcucacgggccuggacugcauccgccccugcuucugggucgagcuggugcgggggcucccgcgcgagaacaccaccaucuggaccuccggcagcuccaucagcuucugcggggucaacuccgacacggccaacuggagcuggcccgacggcgccgagcugcccuucaccaucgacaaguga

SEQ ID NO: 80756 - RNA, 1413 nt, Artificial Sequence; identical to SEQ ID NO: 80755
  derived and/or modified sequence opt1 from neuraminidase__InfluenzaA__ADM95706

SEQ ID NO: 80757 - RNA, 1413 nt, Artificial Sequence; identical to SEQ ID NO: 80755
  derived and/or modified sequence opt1 from neuraminidase__InfluenzaA__ADM95707

SEQ ID NO: 80758 - RNA, 1413 nt, Artificial Sequence; identical to SEQ ID NO: 78469
  derived and/or modified sequence opt1 from neuraminidase__InfluenzaA__ADM95708

SEQ ID NO: 80759 - RNA, 1410 nt, Artificial Sequence
  derived and/or modified sequence opt1 from neuraminidase__InfluenzaA__ADM95710
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacaacaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgacgugcuguggaccagcaacuccaucgucguguucugcggcaccagcgggacguacggcaccggguccuggccggacggcgccgacaucaaccugaugcccaucuga

SEQ ID NO: 80760 - RNA, 1410 nt, Artificial Sequence; identical to SEQ ID NO: 77607
  derived and/or modified sequence opt1 from neuraminidase__InfluenzaA__ADM95711

SEQ ID NO: 80761 - RNA, 1410 nt, Artificial Sequence; identical to SEQ ID NO: 77607
  derived and/or modified sequence opt1 from neuraminidase__InfluenzaA__ADM95712

SEQ ID NO: 80762 - RNA, 1410 nt, Artificial Sequence; identical to SEQ ID NO: 77607
  derived and/or modified sequence opt1 from neuraminidase__InfluenzaA__ADM95713

SEQ ID NO: 80763 - RNA, 1410 nt, Artificial Sequence
  derived and/or modified sequence opt1 from neuraminidase__InfluenzaA__ADM95714
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgacgugcuguggaccuccaacagcaucgucguguucugcggcaccuccgggacguacggcaccgggagcuggccggacggcgccgacaucaaccugaugcccaucuga

SEQ ID NO: 80764 - RNA, 1410 nt, Artificial Sequence; identical to SEQ ID NO: 77607
  derived and/or modified sequence opt1 from neuraminidase__InfluenzaA__ADM95715

SEQ ID NO: 80765 - RNA, 1410 nt, Artificial Sequence; identical to SEQ ID NO: 80763
  derived and/or modified sequence opt1 from neuraminidase__InfluenzaA__ADM95716

SEQ ID NO: 80766 - RNA, 1410 nt, Artificial Sequence; identical to SEQ ID NO: 80763
  derived and/or modified sequence opt1 from neuraminidase__InfluenzaA__ADM95717

SEQ ID NO: 80767 - RNA, 1410 nt, Artificial Sequence; identical to SEQ ID NO: 77607
  derived and/or modified sequence opt1 from neuraminidase__InfluenzaA__ADM95718

SEQ ID NO: 80768 - RNA, 1410 nt, Artificial Sequence
  derived and/or modified sequence opt1 from neuraminidase__InfluenzaA__ADM95719
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaagagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 80769 - RNA, 1410 nt, Artificial Sequence; identical to SEQ ID NO: 77607
  derived and/or modified sequence opt1 from neuraminidase__InfluenzaA__ADM95720

SEQ ID NO: 80770 - RNA, 1410 nt, Artificial Sequence; identical to SEQ ID NO: 77607
  derived and/or modified sequence opt1 from neuraminidase__InfluenzaA__ADM95721

SEQ ID NO: 80771 - RNA, 1410 nt, Artificial Sequence; identical to SEQ ID NO: 77607
  derived and/or modified sequence opt1 from neuraminidase__InfluenzaA__ADM95723

SEQ ID NO: 80772 - RNA, 1410 nt, Artificial Sequence
  derived and/or modified sequence opt1 from neuraminidase__InfluenzaA__ADM95724
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 80773 - RNA, 1410 nt, Artificial Sequence
  derived and/or modified sequence opt1 from neuraminidase__InfluenzaA__ADM95725
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggaggucugcccgaagcuggccgaguaccggaacugguccaagccccagugcgacaucaccggguucgcgcccuucagcaaggacaacuccauccgccugagcgccggcggggacaucugggugacccgggagcccuacguguccugcgacccggacaagugcuaccaguucgcccucggccaggggaccacgcugaacaacguccacagcaacaacaccgugcgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcgucguguccuggagcaaggagauccugcgcacccaggaguccgagugcgugugcaucaacggcacgugcaccgucgugaucaccgacgggagcgccuccggcaaggccgacaccaagauccucuucaucgaggagggcaagaucgugcacacgagcacccugagcggguccgcgcagcacgucgaggagugcagcugcuacccccgguacccgggcgugcgcugcgugugccgggacaacuggaagggguccaaccgccccaucgucgacaucaacaucaaggaccacagcaucguguccagcuacgugugcuccggccuggucggcgacacgccccggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgacguccuguggaccagcaacuccaucgugguguucugcggcaccagcgggacguacggcaccggguccuggcccgacggcgccgacaucaaccugaugcccaucuga

SEQ ID NO: 80774 - RNA, 1410 nt, Artificial Sequence
  derived and/or modified sequence opt1 from neuraminidase__InfluenzaA__ADM95726
augaaccccaaccagaagaucaucaccaucggcagcgugucccugaccaucagcacgaucugcuucuucaugcagaucgccauccucaucaccgccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgacgugcuguggaccuccaacagcaucgucguguucugcggcaccuccgggaccuacggcacggggagcuggccggacggcgccgacaucaaccugaugcccaucuga

SEQ ID NO: 80775 - RNA, 1410 nt, Artificial Sequence; identical to SEQ ID NO: 77607
  derived and/or modified sequence opt1 from neuraminidase__InfluenzaA__ADM95727

SEQ ID NO: 80776 - RNA, 1410 nt, Artificial Sequence
  derived and/or modified sequence opt1 from neuraminidase__InfluenzaA__ADM95728
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccgagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 80777 - RNA, 1410 nt, Artificial Sequence
  derived and/or modified sequence opt1 from neuraminidase__InfluenzaA__ADM95729
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcucccgcagccacugccucgaccccaacaacgaggagggcgggcacggggucaagggcugggccuucgacgacgggaacgacguguggaugggccggaccaucuccgagaagucccgccugggcuacgagaccuucaaggucaucgagggguggagcaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 80778 - RNA, 1410 nt, Artificial Sequence
  derived and/or modified sequence opt1 from neuraminidase__InfluenzaA__ADM95730
augaaccccaaccagaagaucaucaccaucggcagcgugucccugaccaucagcacgaucugcuucuucaugcagaucgccauccucaucaccaccgucacccugcacuucaagcaguacgaguucaacuccccgcccagcaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 80779 - RNA, 1410 nt, Artificial Sequence
  derived and/or modified sequence opt1 from neuraminidase__InfluenzaA__ADM95732
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccgguccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagucccgccugggcuacgagaccuucaaggugaucgagggguggagcaaccacaaguccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggcccgacggcgccgacaucaaccugaugccgaucuga

SEQ ID NO: 80780 - RNA, 1410 nt, Artificial Sequence; identical to SEQ ID NO: 77607
  derived and/or modified sequence opt1 from neuraminidase__InfluenzaA__ADM95733

SEQ ID NO: 80781 - RNA, 1410 nt, Artificial Sequence; identical to SEQ ID NO: 77607
  derived and/or modified sequence opt1 from neuraminidase__InfluenzaA__ADM95734

SEQ ID NO: 80782 - RNA, 1410 nt, Artificial Sequence; identical to SEQ ID NO: 77607
  derived and/or modified sequence opt1 from neuraminidase__InfluenzaA__ADM95735

SEQ ID NO: 80783 - RNA, 1410 nt, Artificial Sequence; identical to SEQ ID NO: 77607
  derived and/or modified sequence opt1 from neuraminidase__InfluenzaA__ADM95736

SEQ ID NO: 80784 - RNA, 1410 nt, Artificial Sequence
  derived and/or modified sequence opt1 from neuraminidase__InfluenzaA__ADM95737
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggccgggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgacgugcuguggaccuccaacagcaucgucguguucugcggcaccuccgggacguacggcaccgggagcuggccggacggcgccgacaucaaccugaugcccaucuga

SEQ ID NO: 80785 - RNA, 1410 nt, Artificial Sequence; identical to SEQ ID NO: 77607
  derived and/or modified sequence opt1 from neuraminidase__InfluenzaA__ADM95738

SEQ ID NO: 80786 - RNA, 1410 nt, Artificial Sequence; identical to SEQ ID NO: 77607
  derived and/or modified sequence opt1 from neuraminidase__InfluenzaA__ADM95739

SEQ ID NO: 80787 - RNA, 1410 nt, Artificial Sequence
  derived and/or modified sequence opt1 from neuraminidase__InfluenzaA__ADM95740
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacgacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccaaggugcuguggaccuccaacagcaucgucguguucugcggcaccuccgggacguacggcaccgggagcuggccggacggcgccgacaucaaccugaugcccaucuga

SEQ ID NO: 80788 - RNA, 1410 nt, Artificial Sequence; identical to SEQ ID NO: 80763
  derived and/or modified sequence opt1 from neuraminidase__InfluenzaA__ADM95741

SEQ ID NO: 80789 - RNA, 1410 nt, Artificial Sequence; identical to SEQ ID NO: 77607
  derived and/or modified sequence opt1 from neuraminidase__InfluenzaA__ADM95742

SEQ ID NO: 80790 - RNA, 1410 nt, Artificial Sequence
  derived and/or modified sequence opt1 from neuraminidase__InfluenzaA__ADM95743
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgguaccccggcguccgcugcgugugccgggacaacuggaagggguccaaccgccccaucguggacaucaacaucaaggaccacagcaucgucuccagcuacgugugcuccggccuggugggcgacaccccgcggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagacguucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 80791 - RNA, 1410 nt, Artificial Sequence; identical to SEQ ID NO: 77607
  derived and/or modified sequence opt1 from neuraminidase__InfluenzaA__ADM95744

SEQ ID NO: 80792 - RNA, 1410 nt, Artificial Sequence; identical to SEQ ID NO: 77746
  derived and/or modified sequence opt1 from neuraminidase__InfluenzaA__ADN05229

SEQ ID NO: 80793 - RNA, 1413 nt, Artificial Sequence; identical to SEQ ID NO: 78469
  derived and/or modified sequence opt1 from neuraminidase__InfluenzaA__ADN06292

SEQ ID NO: 80794 - RNA, 1413 nt, Artificial Sequence; identical to SEQ ID NO: 79938
  derived and/or modified sequence opt1 from neuraminidase__InfluenzaA__ADN06303

SEQ ID NO: 80795 - RNA, 1413 nt, Artificial Sequence
  derived and/or modified sequence opt1 from neuraminidase__InfluenzaA__ADN06314
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgagguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacggcgacacggccaacuggagcuggcccgacggcgccgagcugcccuucaccaucgacaaguga

SEQ ID NO: 80796 - RNA, 1413 nt, Artificial Sequence; identical to SEQ ID NO: 79938
  derived and/or modified sequence opt1 from neuraminidase__InfluenzaA__ADN06325

SEQ ID NO: 80797 - RNA, 1413 nt, Artificial Sequence
  derived and/or modified sequence opt1 from neuraminidase__InfluenzaA__ADN06347
augaaccccaaccagaagaucaucaccaucggcagcaucuccaucgccaucgggaucaucagccugaugcuccagaucggcaacaucaucuccaucugggccagccacuccauccagaccgagagccagaacaacacggggaucugcaaccagcgcaucaucaccuacgagaacuccaccugggugaaccacaccuacgucaacaucaacaacacgaacgugguggcgggcgaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcagcaaccgccccuggguguccuucaaccagaaccuggacuaccagaugggguacaucugcagcggcgucuucggcgacaacccccggcccgaggacggggagggcuccugcaacccggugaacguggacggggcgaacggcgucaagggguucagcuacaaguacggcaacggcguguggaucgggcgcaccaaguccaaccggcugcgcaagggcuucgagaugaucugggaccccaacggguggacgaacaccgacagcgacuucuccgugaagcaggacgucguggccaucaccgacuggagcggcuacagcggguccuucgugcagcaccccgagcucaccggccuggacugcauccggcccugcuucugggucgagcuggugcgcggccucccgcgggagaacacgaccaucuggaccagcggguccagcaucuccuucugcggcgucaacagcgacaccgccaacugguccuggcccgacggggccgagcugcccuucacgaucgacaaguga

SEQ ID NO: 80798 - RNA, 1410 nt, Artificial Sequence; identical to SEQ ID NO: 80418
  derived and/or modified sequence opt1 from neuraminidase__InfluenzaA__ADN06369

SEQ ID NO: 80799 - RNA, 1410 nt, Artificial Sequence; identical to SEQ ID NO: 77746
  derived and/or modified sequence opt1 from neuraminidase__InfluenzaA__ADN26031

SEQ ID NO: 80800 - RNA, 1410 nt, Artificial Sequence; identical to SEQ ID NO: 77746
  derived and/or modified sequence opt1 from neuraminidase__InfluenzaA__ADN26032

SEQ ID NO: 80801 - RNA, 1410 nt, Artificial Sequence; identical to SEQ ID NO: 77746
  derived and/or modified sequence opt1 from neuraminidase__InfluenzaA__ADN26033

SEQ ID NO: 80802 - RNA, 1410 nt, Artificial Sequence; identical to SEQ ID NO: 77746
  derived and/or modified sequence opt1 from neuraminidase__InfluenzaA__ADN26034

SEQ ID NO: 80803 - RNA, 1410 nt, Artificial Sequence; identical to SEQ ID NO: 77746
  derived and/or modified sequence opt1 from neuraminidase__InfluenzaA__ADN26035

SEQ ID NO: 80804 - RNA, 1410 nt, Artificial Sequence; identical to SEQ ID NO: 77746
  derived and/or modified sequence opt1 from neuraminidase__InfluenzaA__ADN26036

SEQ ID NO: 80805 - RNA, 1410 nt, Artificial Sequence
  derived and/or modified sequence opt1 from neuraminidase__InfluenzaA__ADN26037
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaucgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80806 - RNA, 1410 nt, Artificial Sequence; identical to SEQ ID NO: 77746
  derived and/or modified sequence opt1 from neuraminidase__InfluenzaA__ADN26038

SEQ ID NO: 80807 - RNA, 1410 nt, Artificial Sequence; identical to SEQ ID NO: 77746
  derived and/or modified sequence opt1 from neuraminidase__InfluenzaA__ADN26041

SEQ ID NO: 80808 - RNA, 1410 nt, Artificial Sequence; identical to SEQ ID NO: 77746
  derived and/or modified sequence opt1 from neuraminidase__InfluenzaA__ADN26042

SEQ ID NO: 80809 - RNA, 1410 nt, Artificial Sequence
  derived and/or modified sequence opt1 from neuraminidase__InfluenzaA__ADN26043
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccaggugggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80810 - RNA, 1410 nt, Artificial Sequence; identical to SEQ ID NO: 77746
  derived and/or modified sequence opt1 from neuraminidase__InfluenzaA__ADN26044

SEQ ID NO: 80811 - RNA, 1410 nt, Artificial Sequence; identical to SEQ ID NO: 77746
  derived and/or modified sequence opt1 from neuraminidase__InfluenzaA__ADN26045

SEQ ID NO: 80812 - RNA, 1410 nt, Artificial Sequence
  derived and/or modified sequence opt1 from neuraminidase__InfluenzaA__ADN26047
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcugaccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccaacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 80813 - RNA, 1410 nt, Artificial Sequence; identical to SEQ ID NO: 77746
  derived and/or modified sequence opt1 from neuraminidase__InfluenzaA__ADN26048

SEQ ID NO: 80814 - RNA, 1410 nt, Artificial Sequence; identical to SEQ ID NO: 77746
  derived and/or modified sequence opt1 from neuraminidase__InfluenzaA__ADN26049

SEQ ID NO: 80815 - RNA, 1410 nt, Artificial Sequence; identical to SEQ ID NO: 77746
  derived and/or modified sequence opt1 from neuraminidase__InfluenzaA__ADN26050

SEQ ID NO: 80816 - RNA, 1410 nt, Artificial Sequence; identical to SEQ ID NO: 77746
  derived and/or modified sequence opt1 from neuraminidase__InfluenzaA__ADN26051

SEQ ID NO: 80817 - RNA, 1410 nt, Artificial Sequence; identical to SEQ ID NO: 77746
  derived and/or modified sequence opt1 from neuraminidase__InfluenzaA__ADN26052

SEQ ID NO: 80818 - RNA, 1410 nt, Artificial Sequence; identical to SEQ ID NO: 77736
  derived and/or modified sequence opt1 from neuraminidase__InfluenzaA__ADN26053

SEQ ID NO: 80819 - RNA, 1410 nt, Artificial Sequence; identical to SEQ ID NO: 77746
  derived and/or modified sequence opt1 from neuraminidase__InfluenzaA__ADN26054

SEQ ID NO: 80820 - RNA, 1410 nt, Artificial Sequence; identical to SEQ ID NO: 77746
  derived and/or modified sequence opt1 from neuraminidase__InfluenzaA__ADN26057

SEQ ID NO: 80821 - RNA, 1410 nt, Artificial Sequence; identical to SEQ ID NO: 77746
  derived and/or modified sequence opt1 from neuraminidase__InfluenzaA__ADN26058

SEQ ID NO: 80822 - RNA, 1410 nt, Artificial Sequence; identical to SEQ ID NO: 77746
  derived and/or modified sequence opt1 from neuraminidase__InfluenzaA__ADN26059

SEQ ID NO: 80823 - RNA, 1410 nt, Artificial Sequence; identical to SEQ ID NO: 78113
  derived and/or modified sequence opt1 from neuraminidase__InfluenzaA__ADN26060

SEQ ID NO: 80824 - RNA, 1410 nt, Artificial Sequence; identical to SEQ ID NO: 77746
  derived and/or modified sequence opt1 from neuraminidase__InfluenzaA__ADN26061

SEQ ID NO: 80825 - RNA, 1410 nt, Artificial Sequence; identical to SEQ ID NO: 77746
  derived and/or modified sequence opt1 from neuraminidase__InfluenzaA__ADN26063

SEQ ID NO: 80826 - RNA, 1410 nt, Artificial Sequence; identical to SEQ ID NO: 77746
  derived and/or modified sequence opt1 from neuraminidase__InfluenzaA__ADN26064

SEQ ID NO: 80827 - RNA, 1410 nt, Artificial Sequence; identical to SEQ ID NO: 78819
  derived and/or modified sequence opt1 from neuraminidase__InfluenzaA__ADN26065

SEQ ID NO: 80828 - RNA, 1410 nt, Artificial Sequence; identical to SEQ ID NO: 77746
  derived and/or modified sequence opt1 from neuraminidase__InfluenzaA__ADN26066

SEQ ID NO: 80829 - RNA, 1410 nt, Artificial Sequence; identical to SEQ ID NO: 77746
  derived and/or modified sequence opt1 from neuraminidase__InfluenzaA__ADN26067

SEQ ID NO: 80830 - RNA, 1410 nt, Artificial Sequence; identical to SEQ ID NO: 77746
  derived and/or modified sequence opt1 from neuraminidase__InfluenzaA__ADN26069

SEQ ID NO: 80831 - RNA, 1410 nt, Artificial Sequence; identical to SEQ ID NO: 77746
  derived and/or modified sequence opt1 from neuraminidase__InfluenzaA__ADN26070

SEQ ID NO: 80832 - RNA, 1410 nt, Artificial Sequence; identical to SEQ ID NO: 77746
  derived and/or modified sequence opt1 from neuraminidase__InfluenzaA__ADN26072

SEQ ID NO: 80833 - RNA, 1410 nt, Artificial Sequence; identical to SEQ ID NO: 77746
  derived and/or modified sequence opt1 from neuraminidase__InfluenzaA__ADN26073

SEQ ID NO: 80834 - RNA, 1410 nt, Artificial Sequence; identical to SEQ ID NO: 77746
  derived and/or modified sequence opt1 from neuraminidase__InfluenzaA__ADN26075

SEQ ID NO: 80835 - RNA, 1410 nt, Artificial Sequence; identical to SEQ ID NO: 77746
  derived and/or modified sequence opt1 from neuraminidase__InfluenzaA__ADN26076

SEQ ID NO: 80836 - RNA, 1410 nt, Artificial Sequence; identical to SEQ ID NO: 77746
  derived and/or modified sequence opt1 from neuraminidase__InfluenzaA__ADN26077

SEQ ID NO: 80837 - RNA, 1410 nt, Artificial Sequence; identical to SEQ ID NO: 77746
  derived and/or modified sequence opt1 from neuraminidase__InfluenzaA__ADN26078

SEQ ID NO: 80838 - RNA, 1410 nt, Artificial Sequence; identical to SEQ ID NO: 77746
  derived and/or modified sequence opt1 from neuraminidase__InfluenzaA__ADN26079

SEQ ID NO: 80839 - RNA, 1410 nt, Artificial Sequence; identical to SEQ ID NO: 77746
  derived and/or modified sequence opt1 from neuraminidase__InfluenzaA__ADN26080

SEQ ID NO: 80840 - RNA, 1410 nt, Artificial Sequence; identical to SEQ ID NO: 77746
  derived and/or modified sequence opt1 from neuraminidase__InfluenzaA__ADN26081

SEQ ID NO: 80841 - RNA, 1410 nt, Artificial Sequence; identical to SEQ ID NO: 77746
  derived and/or modified sequence opt1 from neuraminidase__InfluenzaA__ADN26082

SEQ ID NO: 80842 - RNA, 1410 nt, Artificial Sequence; identical to SEQ ID NO: 77746
  derived and/or modified sequence opt1 from neuraminidase__InfluenzaA__ADN26083

SEQ ID NO: 80843 - RNA, 1410 nt, Artificial Sequence; identical to SEQ ID NO: 79648
  derived and/or modified sequence opt1 from neuraminidase__InfluenzaA__ADN26084

SEQ ID NO: 80844 - RNA, 1410 nt, Artificial Sequence; identical to SEQ ID NO: 77746
  derived and/or modified sequence opt1 from neuraminidase__InfluenzaA__ADN26085

SEQ ID NO: 80845 - RNA, 1410 nt, Artificial Sequence; identical to SEQ ID NO: 77746
  derived and/or modified sequence opt1 from neuraminidase__InfluenzaA__ADN26086

SEQ ID NO: 80846 - RNA, 1410 nt, Artificial Sequence; identical to SEQ ID NO: 77746
  derived and/or modified sequence opt1 from neuraminidase__InfluenzaA__ADN26087

SEQ ID NO: 80847 - RNA, 1410 nt, Artificial Sequence; identical to SEQ ID NO: 77746
  derived and/or modified sequence opt1 from neuraminidase__InfluenzaA__ADN26088

SEQ ID NO: 80848 - RNA, 1410 nt, Artificial Sequence; identical to SEQ ID NO: 77746
  derived and/or modified sequence opt1 from neuraminidase__InfluenzaA__ADN26090

SEQ ID NO: 80849 - RNA, 1410 nt, Artificial Sequence; identical to SEQ ID NO: 77746
  derived and/or modified sequence opt1 from neuraminidase__InfluenzaA__ADN26091

SEQ ID NO: 80850 - RNA, 1410 nt, Artificial Sequence; identical to SEQ ID NO: 77746
  derived and/or modified sequence opt1 from neuraminidase__InfluenzaA__ADN26092

SEQ ID NO: 80851 - RNA, 1410 nt, Artificial Sequence; identical to SEQ ID NO: 77746
  derived and/or modified sequence opt1 from neuraminidase__InfluenzaA__ADN26093

SEQ ID NO: 80852 - RNA, 1410 nt, Artificial Sequence
  derived and/or modified sequence opt1 from neuraminidase__InfluenzaA__ADN26094
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaaggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 80853 - RNA, 1410 nt, Artificial Sequence; identical to SEQ ID NO: 79648
  derived and/or modified sequence opt1 from neuraminidase__InfluenzaA__ADN26095

SEQ ID NO: 80854 - RNA, 1410 nt, Artificial Sequence
  derived and/or modified sequence opt1 from neuraminidase__InfluenzaA__ADN26096
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagaacaucuccagccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80855 - RNA, 1410 nt, Artificial Sequence; identical to SEQ ID NO: 77746
  derived and/or modified sequence opt1 from neuraminidase__InfluenzaA__ADN26097

SEQ ID NO: 80856 - RNA, 1410 nt, Artificial Sequence; identical to SEQ ID NO: 77746
  derived and/or modified sequence opt1 from neuraminidase__InfluenzaA__ADN26098

SEQ ID NO: 80857 - RNA, 1410 nt, Artificial Sequence; identical to SEQ ID NO: 77746
  derived and/or modified sequence opt1 from neuraminidase__InfluenzaA__ADN26099

SEQ ID NO: 80858 - RNA, 1410 nt, Artificial Sequence; identical to SEQ ID NO: 77746
  derived and/or modified sequence opt1 from neuraminidase__InfluenzaA__ADN26100

SEQ ID NO: 80859 - RNA, 1410 nt, Artificial Sequence; identical to SEQ ID NO: 77746
  derived and/or modified sequence opt1 from neuraminidase__InfluenzaA__ADN26101

SEQ ID NO: 80860 - RNA, 1410 nt, Artificial Sequence
  derived and/or modified sequence opt1 from neuraminidase__InfluenzaA__ADN26102
augaaccccaaccagaagaucaucaccaucggcagcgugugcaugaccaucgggauggccaaccugauccuccagaucggcaacaucaucuccaucuggaucagccaccugauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccaggccuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccuggaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaaguccaucagcagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccggcccugcuucugggucgagcugauccgcggccggcccaaggagaacuccaucuggaccagcggguccagcaucuccuucugcggcgugaacagcgacaccgucgggugguccuggcccgacggcgccgagcugccguucaccaucgacaaguga

SEQ ID NO: 80861 - RNA, 1410 nt, Artificial Sequence; identical to SEQ ID NO: 77746
  derived and/or modified sequence opt1 from neuraminidase__InfluenzaA__ADN26103

SEQ ID NO: 80862 - RNA, 1410 nt, Artificial Sequence; identical to SEQ ID NO: 77746
  derived and/or modified sequence opt1 from neuraminidase__InfluenzaA__ADN26104

SEQ ID NO: 80863 - RNA, 1410 nt, Artificial Sequence; identical to SEQ ID NO: 77746
  derived and/or modified sequence opt1 from neuraminidase__InfluenzaA__ADN26105

SEQ ID NO: 80864 - RNA, 1410 nt, Artificial Sequence; identical to SEQ ID NO: 77746
  derived and/or modified sequence opt1 from neuraminidase__InfluenzaA__ADN26106

SEQ ID NO: 80865 - RNA, 1410 nt, Artificial Sequence; identical to SEQ ID NO: 79648
  derived and/or modified sequence opt1 from neuraminidase__InfluenzaA__ADN26107

SEQ ID NO: 80866 - RNA, 1410 nt, Artificial Sequence; identical to SEQ ID NO: 79648
  derived and/or modified sequence opt1 from neuraminidase__InfluenzaA__ADN26108

SEQ ID NO: 80867 - RNA, 1410 nt, Artificial Sequence; identical to SEQ ID NO: 77746
  derived and/or modified sequence opt1 from neuraminidase__InfluenzaA__ADN26109

SEQ ID NO: 80868 - RNA, 1410 nt, Artificial Sequence; identical to SEQ ID NO: 78720
  derived and/or modified sequence opt1 from neuraminidase__InfluenzaA__ADN26110

SEQ ID NO: 80869 - RNA, 1410 nt, Artificial Sequence; identical to SEQ ID NO: 79648
  derived and/or modified sequence opt1 from neuraminidase__InfluenzaA__ADN26111

SEQ ID NO: 80870 - RNA, 1410 nt, Artificial Sequence; identical to SEQ ID NO: 78720
  derived and/or modified sequence opt1 from neuraminidase__InfluenzaA__ADN26112

SEQ ID NO: 80871 - RNA, 1410 nt, Artificial Sequence; identical to SEQ ID NO: 79648
  derived and/or modified sequence opt1 from neuraminidase__InfluenzaA__ADN26113

SEQ ID NO: 80872 - RNA, 1410 nt, Artificial Sequence
  derived and/or modified sequence opt1 from neuraminidase__InfluenzaA__ADN26114
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucaacaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80873 - RNA, 1410 nt, Artificial Sequence; identical to SEQ ID NO: 77746
  derived and/or modified sequence opt1 from neuraminidase__InfluenzaA__ADN26115

SEQ ID NO: 80874 - RNA, 1410 nt, Artificial Sequence
  derived and/or modified sequence opt1 from neuraminidase__InfluenzaA__ADN26116
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgcgccuggacugcauccggcccugcuucugggucgagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 80875 - RNA, 1410 nt, Artificial Sequence; identical to SEQ ID NO: 79648
  derived and/or modified sequence opt1 from neuraminidase__InfluenzaA__ADN26117

SEQ ID NO: 80876 - RNA, 1410 nt, Artificial Sequence; identical to SEQ ID NO: 79648
  derived and/or modified sequence opt1 from neuraminidase__InfluenzaA__ADN26118

SEQ ID NO: 80877 - RNA, 1410 nt, Artificial Sequence; identical to SEQ ID NO: 77746
  derived and/or modified sequence opt1 from neuraminidase__InfluenzaA__ADN26119

SEQ ID NO: 80878 - RNA, 1410 nt, Artificial Sequence; identical to SEQ ID NO: 78720
  derived and/or modified sequence opt1 from neuraminidase__InfluenzaA__ADN26120

SEQ ID NO: 80879 - RNA, 1410 nt, Artificial Sequence; identical to SEQ ID NO: 79648
  derived and/or modified sequence opt1 from neuraminidase__InfluenzaA__ADN26121

SEQ ID NO: 80880 - RNA, 1410 nt, Artificial Sequence; identical to SEQ ID NO: 77746
  derived and/or modified sequence opt1 from neuraminidase__InfluenzaA__ADN26122

SEQ ID NO: 80881 - RNA, 1410 nt, Artificial Sequence; identical to SEQ ID NO: 77746
  derived and/or modified sequence opt1 from neuraminidase__InfluenzaA__ADN26123

SEQ ID NO: 80882 - RNA, 1410 nt, Artificial Sequence; identical to SEQ ID NO: 77746
  derived and/or modified sequence opt1 from neuraminidase__InfluenzaA__ADN26124

SEQ ID NO: 80883 - RNA, 1410 nt, Artificial Sequence; identical to SEQ ID NO: 78720
  derived and/or modified sequence opt1 from neuraminidase__InfluenzaA__ADN26125

SEQ ID NO: 80884 - RNA, 1410 nt, Artificial Sequence; identical to SEQ ID NO: 78720
  derived and/or modified sequence opt1 from neuraminidase__InfluenzaA__ADN26126

SEQ ID NO: 80885 - RNA, 1410 nt, Artificial Sequence; identical to SEQ ID NO: 78511
  derived and/or modified sequence opt1 from neuraminidase__InfluenzaA__ADN26127

SEQ ID NO: 80886 - RNA, 1410 nt, Artificial Sequence; identical to SEQ ID NO: 77746
  derived and/or modified sequence opt1 from neuraminidase__InfluenzaA__ADN26128

SEQ ID NO: 80887 - RNA, 1410 nt, Artificial Sequence; identical to SEQ ID NO: 78720
  derived and/or modified sequence opt1 from neuraminidase__InfluenzaA__ADN26129

SEQ ID NO: 80888 - RNA, 1410 nt, Artificial Sequence; identical to SEQ ID NO: 79648
  derived and/or modified sequence opt1 from neuraminidase__InfluenzaA__ADN26130

SEQ ID NO: 80889 - RNA, 1410 nt, Artificial Sequence
  derived and/or modified sequence opt1 from neuraminidase__InfluenzaA__ADN26131
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucucccugugcggcgugaacagcgacaccgucgggugguccuggcccgacggcgccgagcugccguucaccaucgacaaguga

SEQ ID NO: 80890 - RNA, 1410 nt, Artificial Sequence; identical to SEQ ID NO: 79648
  derived and/or modified sequence opt1 from neuraminidase__InfluenzaA__ADN26132

SEQ ID NO: 80891 - RNA, 1410 nt, Artificial Sequence; identical to SEQ ID NO: 78720
  derived and/or modified sequence opt1 from neuraminidase__InfluenzaA__ADN26134

SEQ ID NO: 80892 - RNA, 1410 nt, Artificial Sequence; identical to SEQ ID NO: 77746
  derived and/or modified sequence opt1 from neuraminidase__InfluenzaA__ADN26135

SEQ ID NO: 80893 - RNA, 1410 nt, Artificial Sequence; identical to SEQ ID NO: 77746
  derived and/or modified sequence opt1 from neuraminidase__InfluenzaA__ADN26136

SEQ ID NO: 80894 - RNA, 1410 nt, Artificial Sequence; identical to SEQ ID NO: 77746
  derived and/or modified sequence opt1 from neuraminidase__InfluenzaA__ADN26137

SEQ ID NO: 80895 - RNA, 1410 nt, Artificial Sequence; identical to SEQ ID NO: 79648
  derived and/or modified sequence opt1 from neuraminidase__InfluenzaA__ADN26138

SEQ ID NO: 80896 - RNA, 1410 nt, Artificial Sequence; identical to SEQ ID NO: 78720
  derived and/or modified sequence opt1 from neuraminidase__InfluenzaA__ADN26140

SEQ ID NO: 80897 - RNA, 1410 nt, Artificial Sequence
  derived and/or modified sequence opt1 from neuraminidase__InfluenzaA__ADN26141
augaaccccaaccagaagaucaucaccaucggcagcgugugcaugaccaucgggauggccaaccugauccuccagaucggcaacaucaucuccaucuggaucagccacuccauccagcuggggaaccagaaccgcaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 80898 - RNA, 1410 nt, Artificial Sequence
  derived and/or modified sequence opt1 from neuraminidase__InfluenzaA__ADN26142
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacaacaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacucccgguucgagagcguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 80899 - RNA, 1410 nt, Artificial Sequence; identical to SEQ ID NO: 77746
  derived and/or modified sequence opt1 from neuraminidase__InfluenzaA__ADN26143

SEQ ID NO: 80900 - RNA, 1410 nt, Artificial Sequence; identical to SEQ ID NO: 79648
  derived and/or modified sequence opt1 from neuraminidase__InfluenzaA__ADN26144

SEQ ID NO: 80901 - RNA, 1410 nt, Artificial Sequence; identical to SEQ ID NO: 79648
  derived and/or modified sequence opt1 from neuraminidase__InfluenzaA__ADN26145

SEQ ID NO: 80902 - RNA, 1410 nt, Artificial Sequence; identical to SEQ ID NO: 77746
  derived and/or modified sequence opt1 from neuraminidase__InfluenzaA__ADN26146

SEQ ID NO: 80903 - RNA, 1410 nt, Artificial Sequence; identical to SEQ ID NO: 79648
  derived and/or modified sequence opt1 from neuraminidase__InfluenzaA__ADN26147

SEQ ID NO: 80904 - RNA, 1410 nt, Artificial Sequence; identical to SEQ ID NO: 77746
  derived and/or modified sequence opt1 from neuraminidase__InfluenzaA__ADN26148

SEQ ID NO: 80905 - RNA, 1410 nt, Artificial Sequence; identical to SEQ ID NO: 79648
  derived and/or modified sequence opt1 from neuraminidase__InfluenzaA__ADN26149

SEQ ID NO: 80906 - RNA, 1410 nt, Artificial Sequence
  derived and/or modified sequence opt1 from neuraminidase__InfluenzaA__ADN26150
augaaccccaaccagaagaucaucaccaucggcagcgugugcaugaccaucgggauggccucccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80907 - RNA, 1410 nt, Artificial Sequence; identical to SEQ ID NO: 78720
  derived and/or modified sequence opt1 from neuraminidase__InfluenzaA__ADN26151

SEQ ID NO: 80908 - RNA, 1410 nt, Artificial Sequence
  derived and/or modified sequence opt1 from neuraminidase__InfluenzaA__ADN26152
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacagcucccucugcccggugaacggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucccgguucgagagcgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggacccgcaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 80909 - RNA, 1410 nt, Artificial Sequence; identical to SEQ ID NO: 79648
  derived and/or modified sequence opt1 from neuraminidase__InfluenzaA__ADN26153

SEQ ID NO: 80910 - RNA, 1410 nt, Artificial Sequence; identical to SEQ ID NO: 78329
  derived and/or modified sequence opt1 from neuraminidase__InfluenzaA__ADN26154

SEQ ID NO: 80911 - RNA, 1410 nt, Artificial Sequence; identical to SEQ ID NO: 77746
  derived and/or modified sequence opt1 from neuraminidase__InfluenzaA__ADN26155

SEQ ID NO: 80912 - RNA, 1410 nt, Artificial Sequence; identical to SEQ ID NO: 78720
  derived and/or modified sequence opt1 from neuraminidase__InfluenzaA__ADN26157

SEQ ID NO: 80913 - RNA, 1410 nt, Artificial Sequence; identical to SEQ ID NO: 77746
  derived and/or modified sequence opt1 from neuraminidase__InfluenzaA__ADN26159

SEQ ID NO: 80914 - RNA, 1410 nt, Artificial Sequence; identical to SEQ ID NO: 77746
  derived and/or modified sequence opt1 from neuraminidase__InfluenzaA__ADN26161

SEQ ID NO: 80915 - RNA, 1410 nt, Artificial Sequence
  derived and/or modified sequence opt1 from neuraminidase__InfluenzaA__ADN26162
augaaccccaaccagaagaucaucaccaucagcuccgugugcaugaccgucggcauggccaaccugauccuccagaucgggaacaucaucagcaucuggaucucccacagcauccagcugggcaaccagaaccagaucgagacgugcaaccaguccgugaucaccuacgagaacaacaccugggugaaccagaccuacgucaacaucagcaacacgaacuucgccgcggggcaguccguggugagcgucaagcuggccggcaacuccagccucugcccgguguccgggugggccaucuacagcaaggacaacuccauccgcaucggcagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccguggccuggagcgcguccgccugccacgacggcaucaacuggcucaccaucgggaucagcggccccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggguccugcggccccgugagcuccaacggcgccaacggggucaagggcuucagcuucaaguacgggaacggcguguggaucgggcgcaccaagagcaucuccagccggaacggcuucgagaugaucugggaccccaacggcuggaccgggaccgacaacaacuucuccaucaagcaggacaucgugggcaucaacgaguggagcggguacuccggcagcuucguccagcacccggagcugacggggcuggacugcauccgccccugcuucuggguggagcucauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 80916 - RNA, 1410 nt, Artificial Sequence
  derived and/or modified sequence opt1 from neuraminidase__InfluenzaA__ADN26163
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucaucaucgacaaguga

SEQ ID NO: 80917 - RNA, 1410 nt, Artificial Sequence
  derived and/or modified sequence opt1 from neuraminidase__InfluenzaA__ADN26164
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugccucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacgacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 80918 - RNA, 1410 nt, Artificial Sequence; identical to SEQ ID NO: 79703
  derived and/or modified sequence opt1 from neuraminidase__InfluenzaA__ADN26168

SEQ ID NO: 80919 - RNA, 1410 nt, Artificial Sequence; identical to SEQ ID NO: 78969
  derived and/or modified sequence opt1 from neuraminidase__InfluenzaA__ADN26178

SEQ ID NO: 80920 - RNA, 1410 nt, Artificial Sequence; identical to SEQ ID NO: 77746
  derived and/or modified sequence opt1 from neuraminidase__InfluenzaA__ADN26868

SEQ ID NO: 80921 - RNA, 1410 nt, Artificial Sequence; identical to SEQ ID NO: 77746
  derived and/or modified sequence opt1 from neuraminidase__InfluenzaA__ADN26869

SEQ ID NO: 80922 - RNA, 1410 nt, Artificial Sequence; identical to SEQ ID NO: 77746
  derived and/or modified sequence opt1 from neuraminidase__InfluenzaA__ADN26870

SEQ ID NO: 80923 - RNA, 1410 nt, Artificial Sequence
  derived and/or modified sequence opt1 from neuraminidase__InfluenzaA__ADN26871
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacguacaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 80924 - RNA, 1410 nt, Artificial Sequence
  derived and/or modified sequence opt1 from neuraminidase__InfluenzaA__ADN26872
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccugagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucuccuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 80925 - RNA, 1410 nt, Artificial Sequence; identical to SEQ ID NO: 77746
  derived and/or modified sequence opt1 from neuraminidase__InfluenzaA__ADN26873

SEQ ID NO: 80926 - RNA, 1410 nt, Artificial Sequence; identical to SEQ ID NO: 77746
  derived and/or modified sequence opt1 from neuraminidase__InfluenzaA__ADN26874

SEQ ID NO: 80927 - RNA, 1410 nt, Artificial Sequence; identical to SEQ ID NO: 77746
  derived and/or modified sequence opt1 from neuraminidase__InfluenzaA__ADN26875

SEQ ID NO: 80928 - RNA, 1410 nt, Artificial Sequence; identical to SEQ ID NO: 77746
  derived and/or modified sequence opt1 from neuraminidase__InfluenzaA__ADN26876

SEQ ID NO: 80929 - RNA, 1410 nt, Artificial Sequence; identical to SEQ ID NO: 77746
  derived and/or modified sequence opt1 from neuraminidase__InfluenzaA__ADN26877

SEQ ID NO: 80930 - RNA, 1410 nt, Artificial Sequence; identical to SEQ ID NO: 77746
  derived and/or modified sequence opt1 from neuraminidase__InfluenzaA__ADN26878

SEQ ID NO: 80931 - RNA, 1410 nt, Artificial Sequence; identical to SEQ ID NO: 78883
  derived and/or modified sequence opt1 from neuraminidase__InfluenzaA__ADN26879

SEQ ID NO: 80932 - RNA, 1410 nt, Artificial Sequence; identical to SEQ ID NO: 77746
  derived and/or modified sequence opt1 from neuraminidase__InfluenzaA__ADN26880

SEQ ID NO: 80933 - RNA, 1410 nt, Artificial Sequence; identical to SEQ ID NO: 77746
  derived and/or modified sequence opt1 from neuraminidase__InfluenzaA__ADN26881

SEQ ID NO: 80934 - RNA, 1410 nt, Artificial Sequence; identical to SEQ ID NO: 77746
  derived and/or modified sequence opt1 from neuraminidase__InfluenzaA__ADN26882

SEQ ID NO: 80935 - RNA, 1410 nt, Artificial Sequence; identical to SEQ ID NO: 77746
  derived and/or modified sequence opt1 from neuraminidase__InfluenzaA__ADN26883

SEQ ID NO: 80936 - RNA, 1413 nt, Artificial Sequence
  derived and/or modified sequence opt1 from neuraminidase__InfluenzaA__ADN89064
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgccggggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccgccccugcuucugggucgagcuggugcgggggcucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 80937 - RNA, 1413 nt, Artificial Sequence; identical to SEQ ID NO: 78469
  derived and/or modified sequence opt1 from neuraminidase__InfluenzaA__ADN89075

SEQ ID NO: 80938 - RNA, 1413 nt, Artificial Sequence
  derived and/or modified sequence opt1 from neuraminidase__InfluenzaA__ADN89086
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaagaccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgccaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggcgaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 80939 - RNA, 1413 nt, Artificial Sequence; identical to SEQ ID NO: 78469
  derived and/or modified sequence opt1 from neuraminidase__InfluenzaA__ADN89097

SEQ ID NO: 80940 - RNA, 1413 nt, Artificial Sequence
  derived and/or modified sequence opt1 from neuraminidase__InfluenzaA__ADN89108
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucgugagcaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 80941 - RNA, 1413 nt, Artificial Sequence
  derived and/or modified sequence opt1 from neuraminidase__InfluenzaA__ADN89119
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcacccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 80942 - RNA, 1413 nt, Artificial Sequence
  derived and/or modified sequence opt1 from neuraminidase__InfluenzaA__ADN89130
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaacuucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacggcgacacggccaacuggagcuggcccgacggcgccgagcugcccuucaccaucgacaaguga

SEQ ID NO: 80943 - RNA, 1413 nt, Artificial Sequence; identical to SEQ ID NO: 80940
  derived and/or modified sequence opt1 from neuraminidase__InfluenzaA__ADN89141

SEQ ID NO: 80944 - RNA, 1413 nt, Artificial Sequence
  derived and/or modified sequence opt1 from neuraminidase__InfluenzaA__ADN89152
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccaucgacggcgcgaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 80945 - RNA, 1413 nt, Artificial Sequence
  derived and/or modified sequence opt1 from neuraminidase__InfluenzaA__ADN89163
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaaccagcggaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucacgggcaccaucaaguccuggaagaagcagauccugcggacccaggagagcgagugcgucugcaugaacggguccugcuucaccaucaugacggacggccccagcaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgcgacaacuggcacgggagcaaccggcccuggguguccuucaaccagaaccuggacuaccagaucggcuacaucugcagcggcguguucggggacaacccccgccccgaggacggcgagggguccugcaacccggucaccguggacggcgccaacggggugaagggcuucagcuacaaguacggcaacggggucuggaucggccggacgaaguccaaccgccugcggaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccgccccugcuucuggguggagcugguccgggggcucccgcgcgagaacaccaccaucuggaccagcggcuccagcaucuccuucugcggggugaacagcgacacggccaacugguccuggcccgacggcgccgagcugcccuucaccaucgacaaguga

SEQ ID NO: 80946 - RNA, 1413 nt, Artificial Sequence; identical to SEQ ID NO: 79938
  derived and/or modified sequence opt1 from neuraminidase__InfluenzaA__ADN89174

SEQ ID NO: 80947 - RNA, 1413 nt, Artificial Sequence; identical to SEQ ID NO: 80940
  derived and/or modified sequence opt1 from neuraminidase__InfluenzaA__ADN89185

SEQ ID NO: 80948 - RNA, 1413 nt, Artificial Sequence
  derived and/or modified sequence opt1 from neuraminidase__InfluenzaA__ADN89196
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaugggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagccucaagcaggacguggucgccaucaccgacuggagcggguacuccggcagcuucgugcagcaccccgagcugacgggccuggacugcauccggcccugcuucuggguggagcucguccgcgggcugccgcgggagaacaccaccaucuggaccuccggcagcuccaucagcuucugcggggugaacuccgacacggccaacuggagcuggcccgacggcgccgagcugcccuucaccaucgacaaguga

SEQ ID NO: 80949 - RNA, 1413 nt, Artificial Sequence; identical to SEQ ID NO: 80948
  derived and/or modified sequence opt1 from neuraminidase__InfluenzaA__ADN89207

SEQ ID NO: 80950 - RNA, 1413 nt, Artificial Sequence
  derived and/or modified sequence opt1 from neuraminidase__InfluenzaA__ADN89218
augaaccccaaccagaagaucaucaccaucggcagcaucuccaucgccaucgggaucaucagccugaugcuccagaucggcaacaucaucuccaucugggccagccacuccauccagccggggagccagaacaacaccggcaucugcaaccagcgcaucaucacguacgagaacuccaccugggugaaccacaccuacgucaacaucaacaacaccaacgugguggcgggggaggacaagacgagcgucacccuggccggcaacuccagccugugcuccaucagcggcugggccaucuacaccaaggacaacuccauccggaucgggagcaagggcgacguguucgugauccgcgagcccuucaucuccugcagccaccucgagugccggaccuucuuccugacgcagggggcccugcucaacgacaagcacuccaacggcaccgucaaggaccgcagccccuaccgggcccugauguccugcccccugggggaggcgccgagccccuacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgccccgaacuucuacuacgaggagugcuccugcuaccccgacacgggcaucgucaugugcgugugccgggacaacuggcacgggagcaaccgccccuggguguccuucaaccagaaccuggacuaccagaucggcuacaucugcagcggcgucuucggggacaacccccggccggaggacggcgagggguccugcaaccccgugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggccgugcuucugggucgagcuggugcgcgggcucccccgggagaacacgaccaucuggaccagcggcuccagcaucuccuucugcggggucaacggcgacaccgccaacuggagcuggcccgacggcgccgagcugcccuucacgaucgacaaguga

SEQ ID NO: 80951 - RNA, 1413 nt, Artificial Sequence
  derived and/or modified sequence opt1 from neuraminidase__InfluenzaA__ADN89229
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaccacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 80952 - RNA, 1413 nt, Artificial Sequence
  derived and/or modified sequence opt1 from neuraminidase__InfluenzaA__ADN89240
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacggcgacacggccaacuggagcuggcccgacggcgccgagcugcccuucaccaucgacaaguga

SEQ ID NO: 80953 - RNA, 1413 nt, Artificial Sequence; identical to SEQ ID NO: 78469
  derived and/or modified sequence opt1 from neuraminidase__InfluenzaA__ADN89251

SEQ ID NO: 80954 - RNA, 1413 nt, Artificial Sequence; identical to SEQ ID NO: 78469
  derived and/or modified sequence opt1 from neuraminidase__InfluenzaA__ADN89262

SEQ ID NO: 80955 - RNA, 1413 nt, Artificial Sequence; identical to SEQ ID NO: 78469
  derived and/or modified sequence opt1 from neuraminidase__InfluenzaA__ADN89273

SEQ ID NO: 80956 - RNA, 1413 nt, Artificial Sequence; identical to SEQ ID NO: 78469
  derived and/or modified sequence opt1 from neuraminidase__InfluenzaA__ADN89284

SEQ ID NO: 80957 - RNA, 1413 nt, Artificial Sequence; identical to SEQ ID NO: 78469
  derived and/or modified sequence opt1 from neuraminidase__InfluenzaA__ADN89295

SEQ ID NO: 80958 - RNA, 1413 nt, Artificial Sequence; identical to SEQ ID NO: 78469
  derived and/or modified sequence opt1 from neuraminidase__InfluenzaA__ADN89306

SEQ ID NO: 80959 - RNA, 1413 nt, Artificial Sequence
  derived and/or modified sequence opt1 from neuraminidase__InfluenzaA__ADN89317
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaaccagcggaucaucaccuacgagaacuccaccugggugaaccacaccuacgucaacaucaacagcacgaacgugguggcgggggaggacaagaccuccgucacccuggccggcaacagcucccugugcagcaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccgccccugcuucugggucgagcuggugcgggggcucccgcgcgagaacaccaccaucuggaccuccggcagcuccaucagcuucugcggggucaacggcgacacggccaacugguccuggcccgacggcgccgagcugcccuucaccaucgacaaguga

SEQ ID NO: 80960 - RNA, 1413 nt, Artificial Sequence
  derived and/or modified sequence opt1 from neuraminidase__InfluenzaA__ADN89328
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucugggccuccggcagcuccaucagcuucugcggggucaacuccgacaccgccaacuggagcuggcccgacggcgccgagcugcccuucacgaucgacaaguga

SEQ ID NO: 80961 - RNA, 1413 nt, Artificial Sequence; identical to SEQ ID NO: 80945
  derived and/or modified sequence opt1 from neuraminidase__InfluenzaA__ADN89339

SEQ ID NO: 80962 - RNA, 1413 nt, Artificial Sequence; identical to SEQ ID NO: 80951
  derived and/or modified sequence opt1 from neuraminidase__InfluenzaA__ADN89350

SEQ ID NO: 80963 - RNA, 1413 nt, Artificial Sequence
  derived and/or modified sequence opt1 from neuraminidase__InfluenzaA__ADN89361
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucaucauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcgucgccugguccgccagcgccugccacgacggcaugggcuggcucaccaucgggaucuccggccccgacaacggggcgguggccgugcugaaguacaacggcaucaucacgggcaccaucaagagcuggaagaagcagauccugcgcacccaggaguccgagugcgucugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgugaugugcgucugccgggacaacuggcacggguccaaccgccccugggugagcuucaaccagaaccuggacuaccagaucggcuacaucugcuccggcguguucggggacaacccccggcccgaggacggcgaggggagcugcaacccggucaccguggacggcgcgaacggggugaagggcuucuccuacaaguacggcaacggggucuggaucggccgcaccaagagcaaccggcugcgcaagggguucgagaugaucugggaccccaacggcuggacgaacaccgacuccgacuucagcgugaagcaggacguggucgccaucaccgacuggagcggguacuccggcagcuucgugcagcaccccgagcucacgggccuggacugcauccggcccugcuucuggguggagcugguccgcgggcucccgcgggagaacaccaccaucuggaccuccggcagcuccaucagcuucugcggggugaacuccgacacggccaacuggagcuggcccgacggcgccgagcugcccuucaccaucgacaaguga

SEQ ID NO: 80964 - RNA, 1413 nt, Artificial Sequence
  derived and/or modified sequence opt1 from neuraminidase__InfluenzaA__ADN89372
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacaucguggcgggggaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccgugaacggcgcggacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 80965 - RNA, 1413 nt, Artificial Sequence; identical to SEQ ID NO: 80940
  derived and/or modified sequence opt1 from neuraminidase__InfluenzaA__ADN89383

SEQ ID NO: 80966 - RNA, 1413 nt, Artificial Sequence
  derived and/or modified sequence opt1 from neuraminidase__InfluenzaA__ADN89405
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaccuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucacgaucgggaucuccggccccgacaacggggcgguggccguccugaaguacaacggcaucaucaccggcaccaucaagagcuggaagaagcagauccugcgcacccaggaguccgagugcgugugcaugaacgggagcugcuucacgaucaugaccgacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugacgguggacggcgcgaacggggucaagggcuucuccuacaaguacggcaacgggguguggaucggccgcaccaagagcaaccggcugcgcaagggguucgagaugaucugggaccccaacggcuggaccaacaccgacuccgacuucagcgugaagcaggacgucguggccaucacggacuggagcggguacuccggcagcuucgugcagcaccccgagcucaccggccuggacugcauccggcccugcuucugggucgagcuggugcgcgggcucccgcgggagaacaccaccaucuggacguccggcagcuccaucagcuucugcggggucaacuccgacaccgccaacuggagcuggcccgacggcgccgagcugcccuucaccaucgacaaguga

SEQ ID NO: 80967 - RNA, 1413 nt, Artificial Sequence
  derived and/or modified sequence opt1 from neuraminidase__InfluenzaA__ADN89416
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcguccugggggacaacccccggcccgaggacggcgagggguccugcaacccggugaccguggacggcgcgaacggggucaagggcuucagcuacaaguacggcaacgggguguggaucggccgcacgaaguccaaccggcuccgcaagggguucgagaugaucugggaccccaacggcuggaccaacaccgacagcgacuucuccgugaagcaggacgucguggccaucaccgacuggagcggguacagcggcuccuucgugcagcaccccgagcugacgggccuggacugcauccggcccugcuucugggucgagcucgugcgcgggcugccgcgggagaacaccaccaucuggaccagcggcuccagcaucuccuucugcggggucaacggcgacacggccaacuggagcuggcccgacggcgccgagcugcccuucaccaucgacaaguga

SEQ ID NO: 80968 - RNA, 1413 nt, Artificial Sequence
  derived and/or modified sequence opt1 from neuraminidase__InfluenzaA__ADN89427
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucgacuccgacgccgccgacuggagcuggcccgacggcgccgagcugcccuucacgaucgacaaguga

SEQ ID NO: 80969 - RNA, 1413 nt, Artificial Sequence; identical to SEQ ID NO: 78469
  derived and/or modified sequence opt1 from neuraminidase__InfluenzaA__ADN89438

SEQ ID NO: 80970 - RNA, 1413 nt, Artificial Sequence
  derived and/or modified sequence opt1 from neuraminidase__InfluenzaA__ADN89449
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagccgagcgucacccuggccggcaacuccagccugugcuccaucagcggcugggccaucuacaccaaggacaacuccauccggaucgggagcaagggcgacguguucgugauccgcgagcccuucaucuccugcagccaccucgagugccggaccuucuuccugacgcagggggcccugcucaacgacaagcacuccaacggcaccgucaaggaccgcagccccuaccgggcccugauguccugcccccugggggaggcgccgagccccuacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgccccgaacuucuacuacgaggagugcuccugcuaccccgacacgggcaucgucaugugcgugugccgggacaacuggcacgggagcaaccgccccuggguguccuucaaccagaaccuggacuaccagaucggcuacaucugcagcggcgucuucggggacaacccccggccggaggacggcgagggguccugcaaccccgugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggccgugcuucugggucgagcuggugcgcgggcucccccgggagaacacgaccaucuggaccagcggcuccagcaucuccuucugcggggucaacagcgacaccgccaacugguccuggcccgacggcgccgagcugcccuucacgaucgacaaguga

SEQ ID NO: 80971 - RNA, 1413 nt, Artificial Sequence; identical to SEQ ID NO: 79938
  derived and/or modified sequence opt1 from neuraminidase__InfluenzaA__ADN89460

SEQ ID NO: 80972 - RNA, 1413 nt, Artificial Sequence; identical to SEQ ID NO: 78469
  derived and/or modified sequence opt1 from neuraminidase__InfluenzaA__ADN89482

SEQ ID NO: 80973 - RNA, 1413 nt, Artificial Sequence
  derived and/or modified sequence opt1 from neuraminidase__InfluenzaA__ADN89493
augaaccccaaccagaagaucaucaccaucggcagcaucuccaucgccaucgggaucaucagccugaugcuccagaucggcaacaucaucuccaucugggccagccacuccauccagaccgagagccagaacaacacggggaucugcaaccagcgcaucaucaccuacgagaacuccaccugggugaaccacaccuacgucaacaucaacaacacgaacgugguggcgggcgaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcagcaaccgccccuggguguccuucaaccagaaccuggacuaccagaugggguacaucugcagcggcgucuucggcgacaacccccggcccgaggacggggagggcuccugcaacccggugaccguggacggggcgaacggcgucaagggguucagcuacaaguacggcaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 80974 - RNA, 1413 nt, Artificial Sequence; identical to SEQ ID NO: 78469
  derived and/or modified sequence opt1 from neuraminidase__InfluenzaA__ADN89504

SEQ ID NO: 80975 - RNA, 1413 nt, Artificial Sequence
  derived and/or modified sequence opt1 from neuraminidase__InfluenzaA__ADN89515
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucaccgugaagcaggacgucguggccaucacggacugguccggguacagcggcagcuucgugcagcaccccgagcucaccggccuggacugcauccggcccugcuucugggucgagcuggugcgcgggcucccgcgggagaacaccaccaucuggacguccggcagcuccaucagcuucugcggggucaacuccgacaccgccaacuggagcuggcccgacggcgccgagcugcccuucaccaucgacaaguga

SEQ ID NO: 80976 - RNA, 1413 nt, Artificial Sequence; identical to SEQ ID NO: 78469
  derived and/or modified sequence opt1 from neuraminidase__InfluenzaA__ADN89526

SEQ ID NO: 80977 - RNA, 1413 nt, Artificial Sequence; identical to SEQ ID NO: 80940
  derived and/or modified sequence opt1 from neuraminidase__InfluenzaA__ADN89537

SEQ ID NO: 80978 - RNA, 1413 nt, Artificial Sequence; identical to SEQ ID NO: 78469
  derived and/or modified sequence opt1 from neuraminidase__InfluenzaA__ADN89548

SEQ ID NO: 80979 - RNA, 1413 nt, Artificial Sequence; identical to SEQ ID NO: 78469
  derived and/or modified sequence opt1 from neuraminidase__InfluenzaA__ADN89570
